United States Patent 11,882,838 (BACTERIAL INOCULANTS) - sequence listing, part 10

SEQ ID NO: 3978 - DNA, 5196 bp, Unknown
  Kingdom: Bacteria, Phylum: Actinobacteria, Class: Actinobacteria, Order: Streptomycetales, Family: Streptomycetaceae, Genus: Streptomyces
cggcggcgtcggcggcgaggatgccgagggcctggtcgacgatctggtcaacggggtggggtgcggtgcggtgcatgccacggacggagtcccagccgagcggtgcggcggtggggaccctggtgagggcgtcgttgacggcggccaaggcggtggcgggggccggatggccgccgacctgggcggcgagcaggacgcgtacctgttcgcgcagggagcgcaggcgtgccgcgcagatctcctgcaaaccggcgtccgcgggggccaggccgtggtcgagcaaccactggttggcgccggagggcgtgcccaacgagtcgaggaactggccgcccggcagcgcgatggcgctgttggcgaggtcgagcgcggggtggtgctcggcgcccggcgcgggcgggagcccgggggcgacagtttcgacggtggcgacggtaccggtctcactcacatatctcacgctacagcttgccttcatccgtgacaagcgcttatggtcacggatgaaagtcaatctatccgtgaggtgatttcgtcatggcagtaaccggcgcgtccaacgagcaggtccccatccgtgtcttcggcggtccgaccgcgctcatcgagtacggcgggctgcgcttcctgtccgacccgaccttcgacgctcccgggacctacccctcggggctggccaagaccgcgcccgcctccgccactcccgctgatctgggccgtatcgacgtcgtgctgctgtcgcacgacgagcacgacgacaacctcgatgcctcgggccgggctctgctcgccgatgtccccctgaccctgaccacacccagtggcgcggacaggctgggcggcaccgcgcgcccgctgaaggactgggagtccatcgagctggaccgtcccggcggtggcacgatcaccgtcaccggcgtcccggccctgcacggtcccggggctcgcgaggatctcgaaccggtcgtcggcgaggtcgtcggcttcgtcctgagcggtgatggcctgcccactgtctacatcagcggtgacaacgcccagctcgccctcgtccgtgagatcgccgaccgattcgggccggtggacaccgctgtactgttcgccggcgcggtccgcaccccggtcctggaccgctcgctgctcacactcgacagcgctcaggccgccgaggccgcccgcatcctcggcgcccgccgcatcgtgcccgtccacttcgacagctgggcccacttcaccgagggcggcgacgagctcgtcgccgcctttgccgccgccgctctcaccgaccgcgtcgacttcggcatccgcggctgatcccaactgcgtcgcacgcgtacgtcggacagccgggccgccggccgacaggaactgccacgacggtcggccggcgcccccgcgcccgtacacctcgaaaccgaaggaccgcacgaccatgaccgaccccatccgcggcacctgccacggttccgccccggcggccctgtccgtactggactccgccatgaccggcaccggtcagagcgccgcagaggcgctggccggcagcatcgaactcgcccggctcgccgaccggcgcggcttcacccggtactggatgaacgagcaccacgccatgcctggcgtctccacctccagcccgcccgttctgctggcccggctcaccgcggagacccgcaggctacggctcggcgcgggtgggatcatgctgcccaaccacccgccgctggtcgtcgccgagcagttcggcatgctgaacgccctcgcccccggccgtatcgacctgggcctcggtcgcgcccccggcaccgatcacgccacggccgccgccctgcgccgcggcgcgagcgacgccgaggacttcccccggcaggtcaccgagctgctgcacttcctcggcgacgacttccccgccgaccacccctacgcggagcgcgtgtacgccgtgcccggtcctgcccaggaccggctcaacggcgtcaccggtcccagcggcggcctgccggtgtggctgctcggctcgtccggctattcggcgcagctcgccgcgcggctcggccttccgttcgccttcgccgcacatttcaacccgcgcgacgtggcggccgccctgcgcctgtaccgcgagcggttcactccgtccgaggccctggccgagccgtacgcgctggtcagcttcaccgtcgcggcatccgacgacgagcgggaggcccgccgtcaggccggcaccctcgcgcacgccatgctccgcatgttccagcgcaagtcctacctgctgccgtcccccgaggaagtggacgcctacccctatgacgccgaggaacgccaggccgtggacagctggctgacccacgtcccgcacggcacccccgcacaggtcaccgcgcacctcaaccaggtccagcgggactccggcgccgacgaactcatgatcggcagcgtcggccactccgtccaggcccggctgcgctccaccgaactgatcgccgacgcctacggcatgcccgacagtcctcgctgacgatcggatcgcgcgggcctgtcgctgtgccgggcctcacccgttgggcatcgcgcgtcagggccgtccgtcgggatcgggccactcggtgagtgggctcgggtccgcgtgcgccgcttgtggcggcctcgttgctccgcgcccgggggagtacctgcccgacgacatcggtgccgcactggcacaccgacgggcgatatcttgacgctgaaatgacgctcgtgacgatcgtcgctgtcacccgcgcgctcaaggggatcaacggcgacgggaactccccccgccgtcgccggagtggtgcgtgaggggggccgcgtggaacacgcggacatgccgcacgccgaacaggccccgtcaatttgcgatgatgaatccatggggaaaagcgctctcatcgtggtcgacatgatcaatacgtacgatcaccccgatgccgacctgctcattccgtccattcggagcgcactgccgcacatcgcgcggctcatcgcgcgcgcccgctcggaagatgtcccggtcatctacgcgaacgacaatttcggagagtggcgatcccaccacggagagatcgtcgaaaagtcgctcgcgggaaagaacgccgagctggtcgaacccatcctgccggacgacgaatctctcttcgtcgtcaaggcccggcactcgatcttctacgagacgccgctcagctatctgctctcccgactgggcaccgaccacctcgtgctgtgcggacaggtcaccgaacagtgcgtgctgtattcagcgctcgacgcccacatccggcagctgcgcgtcaccatccccaggaacgccgtggcacacatccacggcgacctcgccgacgcggccctgcgcatgatggaacggaacatgggagccaggatcacccccgcggaggacgtcactttctgacacgggtacgcgaaggagccgcagtaccgccccgggcccgcggcggatgcgtccgccatgaaccgtagagctcacgcgaggtagtgggcgtgcccctggtcgtcgaggccaacggagccggagccctcggggatgatgcagaactcgttgccctcggggtctgacatcaccaggaaaccgccatcggagtacccctccaggcgtcgccctccgagcgcctcgacccgctgctgctcggctgccgggtcgggagacgcgaggtcgaagtgcatgcggttcttcccgggttcggcctcaccggcctgttggaagccgaggcccaggccgtcctcccgtcgcagccagacgtacggacccgtacggtccacgatcggtcggccgagcagctcggaccagaacgcggcgagccgctcgggggcggcggcatcgatgatgagggtattgatctgcaggggcacctctggcatacctcgattctctgtcgcaccccgcgtggtcgcacagccaccgctgacggacgcagaagcccgcgccactcaggttctccctgcgcggcattgtgccgcggtgccgcgcagctgttgttgcggagcactcagccgaaaggggatgggtttacccgggggttcagcctgttaccagtagtgccgacgtcctcccaccgcgtgcccaagggctccgagagcccacagcaccgcaccgatggccaccaggatgatcccgatggtccacagaacgccgatgccggcgatcaggccgatgaccaggagaatgaggccgaggatgatcatggcgcctcctatcatggacacctctgataccaggttcgcgccgtcgtgcccagcccacaacaggagcgacccggcgccggccgccaccgacacggcatctgtccccggccggtgtcggatgacgagacccgggtacgcggcgttgcgtcaccatccgattccgatcgccacagggagtgagcatgtcgaagatcgaggagtccgtcgaggtcgccgttccggtgcgcacggcctacgaccagtggacgcagttcgaggagttcccgcagttcatggacgcggtgcagcgtatcgagcagcgcacgcccaccctgacccactgggtgaccaaggtggacggtgtggagcgggagttcgacgcggagatcaccgagcagatccccgacgaacgggtcgcctgggccacggtggcgggcgaggtccgtcaggccggagtcgtcaccttccaccgcctggacgacacccgcaccaaggtcatgctgcaactcgaccacgacccgcagggcatcgccgacaccgtcggcgacaagctcggcttcgtccgccgccaggccaagagcgacctgaagaacttcaaggagttcatcgagtcccgcggcacagcgaccggcgcctggcggggcaccgcctgagaccggctccgcccttgcggtgcggcgcccgtgcggtgccgcaccgcaaggacatccccacgccctacgggacaggccactggccacccgcgtggggcgcagcaggaccgcggtcctcaccggcggcgggtggagcgtgtgcaggtggcggcagaagtccaggaactgggcgcggctgcctccaaccctctgggaagggcgccgtcgcttgctcttcctgccgttcgtgaaactctccctcgccgggccggcggacggcgcggtgatccccggctcggcccggctgctcccggccgggagaccgcctctcgggccgacgtgccccggctccgcgacgccctcc

SEQ ID NO: 3979 - DNA, 2328 bp, Unknown
  Kingdom: Bacteria, Phylum: Actinobacteria, Class: Actinobacteria, Order: Streptomycetales, Family: Streptomycetaceae, Genus: Streptomyces
gacctggagcacgtactgtccgcccccgaaggtgaagccgcgcacgtactcgcctccggccccgcccgtcccgtcctcgaagccgtagccgaagaggtacgtctcaccggaccgcagccgggtgtcgaagagcagctccgccaccagcacccccgcgtcccggtcccagcggatccggcccgtccggcagttctccagagcccgcaccgcgatccgcgacgggtcgcagccggggtcgccccggtggaccgcgagatagcggtcgacgccgtcccgatgcgcgcgcaccacgtgctgcgacgtgcggcccgccagctcgcgccgcgccccgatccgtacccgctcctggtgccccacggtgtgcaggccgccgtccaccggtgactccatggccgcgaggagccgctccaccgagcccgacgcctccatgagcgaccggtacgagcggccggccggacggtccccgtccgccggagcgtcaccgtcgcgcagcagccgcagcagcgagtcgtccggcagtgcgagtacctcctccagcgcggcgacggcccgcagcgactcggcccgccggggtcggcgcaccccctgctgccagtaactgaggctggtcaccccgagcttgacgccccggtgcgccagatggtgctgcacccgctggagcggcagcccgcgcacggacagagcggtgcgcaacgccagatggaacggtccggtccgcagtacctgcgccagttcggtctcggtctgccgcaatgcgggcctccggtgaacgttcacgtggggagtggcgacaccgcccccgggggacgcgggggagcaggtgaccgggacgggaccgttcacacggacgccgtgccgttcacaccgtgatgtcacctcgcattgaagcgtgttgacctgctccggacaacgtcggatgctcctcatcagcgtccggacgcgctcctccgatccccacccccgcattgggaggaacgccatgcgcaaccgaagagtcaggcccggaaggttctcgttcaccgctctcctggccgccgtcctgctcgccgtccccgcgggcaccgccaccgccgcccagtccccgggcgggaccggccccaccgtcgccgccgcccagcggctcgacatcaccatgcaggcgcaacagcagaccaactggtgctgggcggccggcggcaacaccatcgccgcctggttcggacgcaactactcccagaaccagttctgcaacgccgccttcaaccgcagccagaactcccagtgccccaactcgcaggccaccctcggcaacgtccagaccggactgtcctgggccggggtcaggcccggcagctacgtcaccggctggctgcgctacccgaccgtgcaggccgagatatccgcccagcgccccatcgagacccgtatccagtggtcgtccggcggcggccacatgcatgtcatctacgggtacgacgacgccaacagctgggtctactggggcgatccgtggccctccagcgaccgctacaactgggcctcgcacgcctggtacgtcaacaacaacgagttctcctggacccactcgctctaccggatcggggcgtgaggtcatgaactccaccacccggcgcatcgccgtcgccaccgccctcaccggcgccgccctgttcaccgcagccgctcccgccctcgccgacgacggccggacggccccgccgaagctgaccgccgccaccctcgaagcggcccacgaggccgccaccgagcccgcgaccctggacaccctgtcccggttcttcgcccgggagggtgcggtgagcagggcggcgagcgcacccaggatcgaggggaggaccgttcccgtccgcacgctctccgccgccttcgtcgccgggaagcccggggccgccccgagcacggtggactacctggccagcaccgccgtctcctccgacggccagaaggcctccctgtggaccgtccccgtcacggacgggagcgaccggtggcaggtggtgaacatcgccaccggcgacgacgaggcccgctacaccgcacagggggcccgtgcgctccccggcggcaccgtgttccgcgaaccgcagatcgacgcgtggtacgtccacgacggctcgcgggtactcccgctggacgaggacgcgaaggccgccgtgggcgcacgcggcaccgcgctcagcgcctaccggacccgggtccaggaggcgtacggcgacaagctgcccggctccggatacgcgcgttccggcaaggcgggcggctacggccgcgacgcggccaccggcaccgggggagccccggcggcggcaccagcccccggcccggtct

SEQ ID NO: 3980 - DNA, 1535 bp, Unknown
  Kingdom: Bacteria, Phylum: Actinobacteria, Class: Actinobacteria, Order: Streptomycetales, Family: Streptomycetaceae, Genus: Streptomyces
gacacggaggcggtcgccgcccggacaccgcgctccggtgtggagtcggatggtgcgcagtgggacggtgcgcagttgaacggcctgctcgcggccgtcggcttcgccatgcggccgaaggtccgccccgatctgcggcccgccgccgagcactatctgtccacgcacctggacgaccacacctggcgctacttcaagcgccgccggctggcctcgctcgcgcttcccggagtggtcccggcccggctggcgttcctgcggagcagcccggccttgcgccgggtggcccggcgggccaaggcgttgcggaacggccggggctgagcggcagaggctgaggagcccccggagcgggcaaggcgggcaggcgcgcgggctcctcggcccagcaccttgctcgcacccgccccgaggggtgcggcaggtgcgcgggacggtcagcccagcaccttgctcgcacccgcccggccccacagcatggccgcgccgaacgacagggccgtcgtggccaccgtgaccccgaccacgagcgacgcggcggccgggccgcccatgtccgtccggacgaaggcgtcggtgaggacgccgagcacgagtacgtgcaccagataggccccgaacgacgcgtcggccagccgggtcagggtgcggcgcatccgctccggaacgcgcagtccgtgcagggagatcaggacgccgcagctgaacagagccaccaggacgtgtgcgtacgggatcgcgtagtgcacctcgtgctggtacgcgatcaccccggccagtccggccaccgcgagcagcacccacgggagccgccgccggccgaacgtgcccgccggggcggcgagcagcagcgctccgagcaccgcgtagatcagctggtacggcccgaacgcccagccgaagcgcggcagttcgcggccggtggcctcggccagatcaccgaagagcgacggcgcggacgccaggaccagcagcaccgcgccgaggccccacggccgcttgcccgacctgaccagcaccaccagacccaggaccatgatcacggggaggtaggcgtagaggtaccagaggtggtaggcgggccggaccgaggcgaacacggagtccagcgccagctcgcccaccgggtcgtcgttggttccgcgcagcctgccccaggcgaggtagagagccgtccagacggccaggggcaccacgatccgcacgatgcgccgccgcagccgggcgccgtccttcggcggggcaccgaccaggaccacccagccggcgatggcgaagaagagaggcacggcgaagcggccgacggaatcggcggtcagcccggcccagtaggtgccgggcccctgcgaagccgtccggccgacggcgttcacgaaggcggacccggcgtggaggccgatcacgccgaacgagcagagcagccggatcaggtcgatgtcgtagcggtgctcgcggacgggacgaggcgtctccgggaccgtcggcgccggagcgggggcggggggtgtggtcgacatggtcctcagggggtggac

SEQ ID NO: 3981 - DNA, 864 bp, Unknown
  Kingdom: Bacteria, Phylum: Actinobacteria, Class: Actinobacteria, Order: Streptomycetales, Family: Streptomycetaceae, Genus: Streptomyces
gtggggggccgaaggaagtggcggaggtgtagagcacgttgagcggcccgaacagggtggtcgccccgcgcagcgcgccgacgaggagcgggttgccgaccgcgccgaggccgagcacggagagctggccggtcgcgtttcccacaccgaactcgacggtgaagcgctgcccgagatggccgcgccgcagcatcgggcgcagccgcaccggggtccccgcggtggcccggtggaggagggcggcggacaggaggagggcgggcagggcggagaggccccagacggcgatcaggcgcgccggggacgcaccgtagtcctgtgcggcgagtgctcccagcacgcagcccagccgcaacaggtcggcggccagagcgagatgggggtgctggagggtggagaaggcataccgtccggcgtcctgccccagcaccacggggagcacgaggccgagcgccatcagtgcgcgggcggtgtcgccggggacgaggaggcagacggcagtgagcagcgcgccgagggcggccgaggcgaggacggtgaaggcgacggcggaccggcaggccccccgggtctcctcccccgtgccgcgcttgaggacgaggggctgcccggtgtacgcgcccgagacgccgaggagcaccgtgaagaccaggtagaccgcggagaagcgggcgaaatcggtgagggtggagagccgggcggcggcgaggagcaccaggatgttggtgagcgccgccacgccctggtccgcgaccgagcagaggacggcggtgcgggctctcaccggcgcgcggccggcagggtgaaggtacgcaggccgagggtctcggtgggatcgccggtgttctcgggagcgtccggcgc

SEQ ID NO: 3982 - DNA, 1696 bp, Unknown
  Kingdom: Bacteria, Phylum: Actinobacteria, Class: Actinobacteria, Order: Streptomycetales, Family: Streptomycetaceae, Genus: Streptomyces
  misc_feature (1120)..(1121): n is a, c, g, or t
cctcggcggcgaaacgccgggcgatcgccaagccgatgccgctggaggcgccggtgacgagcgcggtcttgttgtccagttgtcccatgagactctccaagcccttgtcgtaactgttttggttacatcgatgagcgcaaaatgcgcccctggattattgggggaagatggcaatccgatgtcaggcggctttcaggacatccctcagtacgtcctccagcgtggtcttggccagctccctgcgcagggtggcctccacctcgtcgtacacggccgtcagcgccggcccgatgccgtggcccaccacgcagtcgggatccggtgtcgcgcgatgcagggcgaagaccggccccggttcgatcgcctggtagacgtcgagcagggtgatcgccgccaagtctcgcgcgagcatccaacccgcccccgccccccggcgtgaatcggccaagccggccttgctcagttcggccagaaagcggcggatcaccactgggttggtgttgacgctcgtcgcgatctgctccgaggtggcgacctcgtggccatgccgctgatacagcccgatccacgtcagggtgtgcgcggcgatggtcagtctgctgttggcgctcacgtcggactccgccttcctcacccctgggtctggttgtaaccgtacttgttacgactgtctgcggcaagtcctgcgggaccgggcttcgtcagcccgcttggcgcgtgtagccggccttcttcactcacggcgggacgggctttcggggtccatgcgcgacaggcttgaagccactgaactgggaaggccgtcgtcccggagggaccgagtcctgttccggggtgtggatgtgttcgcgcttccggcccgcgaggtggtacggcgcgtcggtgagttcacctcgatcgacgaagatcctgacgacgatgcttcgttcatcgccccggacttgctgctgagcttctggcgtccgttcgcagccgacgaggggccggaggaggagcagggctactacttcagctcggtcctcctggcacggcctggctactacgacactcctgctcaggctgcggagcgactccagcagagctcgtgactgtcccgccagggccggcgggactcgtctcnngccggcccggccgtacatctggcgcccgatcattctgatccggtcgacgtgtccttcgacgatgccggacctccacggcggtgtcaggccggcggtgacagcggcgggatcgcgttcgaggccgttgacaaaggcgaaggccgcgagttcgggaagccctcgacccatcgctcgtgcagtagggctcgaagtcgtcgggcttggtcctgcggttctgcctctgtccctggaacaggacttccggccttgcggcgtcggcctgcggcgcgcctacggtggcgtgcttggcacgggcgcggtcggcgaactggaccgcgctgggtgctctgccatttgcggctcaaccgggtcgacgccactgccggccatgatgagcgtccttggtcgctgacctgtgcgcatggtctttgagctgtctcttggtcgtgccggtcccacacgagcggggaccggcaccacgtacgtcagcggctacggattgacgcagccgatcgagccgaccgggaagttgttgccggtcgatgtggcagtgaacccgaaggtgacgctgctctccggtgcgatggtgcggttgt

SEQ ID NO: 3983 - DNA, 1043 bp, Unknown
  Kingdom: Bacteria, Phylum: Actinobacteria, Class: Actinobacteria, Order: Streptomycetales, Family: Streptomycetaceae, Genus: Streptomyces
ctcacgttcttcgtcggcggtggcgctgccgacgccgccgccgacgaagaacgtgaggttgagcagccccatcgctccgccgcgccgggccggttcgatgtgcgccgacatcagcgcggtggtgaagacctgcgtgacggagaacgcggagaagccgagcgaggcgccgaggatcagcagcagcacgccggagcccgtcagcgctccgccgagggccgcggcgaaggcgagcgagaccgcgcccaggagccggttgccgtggtcacccgcggtgagccggccggccagccgggagagcaccgcgccgacgaccgcgccgggcagcagccagacgccgacggacaggacgctccagccgtggtcgcggacgaggagctgcggtacggcgtacatcgccgcgaacaggccgccgtacacaccgatgccgatgaccgcggccttcaggaacacccggtcggtgacgagcgcacgcggcacgaaagaggtctcgctgccgcgcgtgcgccaggtgagcccggcggccgagaggaccagcacggcggcggtcgcgatcaccagcggggtgctcagcccgagcgcggaggactggatcagcacgaggaacgacatggcggtgagcgtcagcagagccgcgcccggcaggtccatcgagcggccggagttcttgcgcaccggtgctccggccaggcacaggggaacgatgagcagggagagcgcgggcaggaccagagcgatgcgccaggtcacccactcggtgaagacgccgcccgccagggtggcgctggccgagaagatcgccatcgtcgcgccgaatccggcgaagacctgcgggcgccggtccggtggcaccgaggcggtgagcgccatggcgcaggccgccatggcgccggaaccggcggcctggacgaagcgtccggccaccaggacgccgaggccgggcgcgagaaggcagacgacggcgccgaccgcgagggccagcgagccgagcagcagtgcggcgcgtacgccgcgggtgtcggcgaggcggccgaacagcgcggtgc

SEQ ID NO: 3984 - DNA, 2402 bp, Unknown
  Kingdom: Bacteria, Phylum: Actinobacteria, Class: Actinobacteria, Order: Streptomycetales, Family: Streptomycetaceae, Genus: Streptomyces
gtggtggagagaggtgggccaggatgcggcgaccgggagtggcgagaagggcgttcgtgctgggcgcggccggactggtggcggcgatgacgtcggccggtgacgcggtcgcctccccggtgggcccggggcggcgcccggccaggtgcgcggcatgtgggtcgccacggtcgccaacatcgactggccgtccaagccgggtctcacggcggcgcggcaggaggccgagctgttcgcctatctggaccgggcggtcgagctgcggctcaacgcggtggtgttccaggtccggccgaccgccgacgccctgtggccctcgccgcacgagccgtgggccgcctgcctcaccggaacccagggaaaggatccgggctgggacccgctcggcacggcggtgcgcgcggcgcacgaccggagcctggagctgcacgcctggttcaacccctaccgggtggcgaaccacaccgaccccacccgcctcatcgcctcccacccggcccggcagcacccgggatgggtcctgccgtacggcgggaagctctactacaaccccgggctgccggaggtccgccgcttcgtccaggacgcgatgctggacgccgtgcggcgctacgacatcgacgcggtgcactgggacgactacttctacccgtatccggtggccggtcagaccttcgacgacgacgcggagttcgagcggtacggcggcggtttcgccgaccgggcggcctggcggcgcgacaacatcgaccggctcgtgcgcgagacggcggagcggatccggcagatcaagccccacgtccgcttcggcatcagccccttcgccgtctggcgcaacgcggctaccgacccgctgggttcggacacccgggcgggcgtgcagacctacgacgacctgtacgccgacacccgtaagtgggtcaaggaagggtggatcgactacatctgcccgcagatctactggcacatcggccagagcgccgccgactacgccaaggtcctcgcctggtggagcaggaccgtccggggcacgggcgtcgatctgtacgcgggcgaggcgctgtacaaggcgggcgaccccgcccagccggatccctggcaggacccggcggaactctcccgccacctcaccctcgcccgggaccacccggaggtgggcggccatgtcttcttctccgggaagagcgtgatggcagaccggatcggtgccatgcgacgcgtggtggccgaccactacacggaccgggtccggctctacccggaccggggccgcacatatccgcaccgcggccgcccttcgaggtgaacgtcccgggacccggtctccggcgggacgcgggggccgggccctggcgtacggtcccggccccggcgctcctagcgccgctcgtccttcggcgtctccatgtgctggacgacgctgtcggggcccggcgacatcaggtgttcgtggccgtcctcgaagcggagccggtacgggggagcgcccccgtcgccgagcacttcgatgatctcggcgacccggtcgtgctgtcccacggtcctgccgtgcatcagcagccggtcgcccgtgtgtgcctccatcgggagcgacctcctcacaggggagacggtgtcgtgtcgacaagtctatgaccgtatgcgccgggattcccccgctgcgccgcggccggcccgctgggtggcggcgatgcagacgagcacggccaccgccgcgaccggagccgcggcggacatctcctcgccgagcagcagaaaggaccacacgagcgtcagcagcggctgggcgagctggagctgactggcccgggcgacgccgatcgctgccatgccccggtaccagacgtacagcccgaggaaggtcgatccggcggcgacccagaccaggccgaggacgccgtggacgttcaggtgcacgggttcgaggggcagggccaccaggctgcccgccaccgcgagcggcaggcacaggacgagggcccagccgatcacgtgccatcccggcatcagccgggccagccggccgccctcggtgtatccggccgcgcacacgagcagcgcgccgaacaggtacaggtcgccggaggcgagcgcgccgccgctctgctggacggtgaaggcgatcaccacggcggctccggtgagggccgcggtccagaacgtgcgcgacggccgctcgcccgtgcgcagggaccccagcaccgccgtggtcagcggcagcagacccacgaccacggccgcgtgcgaggtggtcgaggtctgcagggccagcgtcgtcagcatcgggaagcccaccaccaccccgcctccgacgaccgcgagcccggcccagtgccggcgatcgggcagcgggacgcgcgcggccagcagcacactgcccgcgatcagggcggcgagcacgc

SEQ ID NO: 3985 - DNA, 3808 bp, Unknown
  Kingdom: Bacteria, Phylum: Actinobacteria, Class: Actinobacteria, Order: Streptomycetales, Family: Streptomycetaceae, Genus: Streptomyces
ggcggaggcctcgggagtgggggtgggagtgggaacgggtgcgggggacgtgcccccgcacccggccagggcggcgccggtcagcacccccacgaccgtcagcgtcgtcatcttccgtgcagtagtgatcactcacggaaaatatccgacaaaatggtcatatcttctgatggcgctccggcgctccggcgtccaggcggagagagctacctcagcaccacggccccgtcaccgcgaacgtggtccccggcgtgtagcagttcacgtacatcgtcgagccgtccggggagaaggcgacccccgcgaactcgccccactccggctcctcgggcgtcccgatgttctgccgcccgcgcgccatggtgtacacctcgccccgccgggtcaccccgagcacgtgctgcgcgccgccgccgtcctcgcagaccatcagcccgccgtccgccgccaggcagatgttgtcgggggactcgccgggcagctggatgtcggtgtccgggccgaagatcacgaccagggtgagccgccgcttcttcggctcgtagcgccagacctggccgtagtggtcggccgccgagccctcggcgctccgggcgaagctggagacgaagtagacggacgagccgccccagtagcagccctccagcttctgggcgtgcgtgacgcccttcggaccgaagtcctggaagcggatcgcggtctccgcggccagcggatccggtacggggacccactcgatccggtcgaagctcgtaccggtctcccggacggcggagaggtcgggtacgcccggcacccgcatcgcctccagcgccccgcccgcccggagcgaaccggtgccgccgagcggcttctcgggaaggaagcggtagaagagcccgaacggcttgtcgaacgcgtcctccgtctcgtacacgatcccggacttcgggtcgacggcgatggcctcgtgctggaagcggcccatcgcggtcagcgggacggccccggtgcggcgcggatcggcgccgtccacctcgaagatgaagccgtggtccttggtgtacccgttggtcccggccttgtcctcgttctcctcgcaggtcagccaggtgcgccacggggtgggcccgcccgcgcagttcaccgccgtaccggcgatggcgacgcgctcgccgagcaccttgttgcggccgtccagctccagggacgtacagccgcccttggccatcgggtcgtaggtcagcccttcgacggtcggtacgccgatcttggcggtgtgccggttctcgtggttgcggacgaggtggacccggccgttgcggccgggcagggcggccatcccgtcgtggttgctcggtaccggaccctcgccggagcgcagggggtcgccctcccgggacagcacccggtagcggaatcctttcggcaggtcgagcaggccgtcggggtcggggacgagagggccgtagccgtcgtggccgcgtgcggcggccgtgcccgcgaagagttcggagaaggctcccgtgaaggcgatcgcggcgaccgcgccgctgcctgccaggacctggcgtcgtgtcgtggtggtgcggggtgcggatgacatgaggtgactccctgttggcggacaggtgaagtgacccgcacgtgtgtagcacgcacagaggcgcgggggaaccatgcgtgcccccgcgccctgtgttgccgctgtggcggcccccatgggagcggccgtgccggggaaggtcaggcgagcgaggccgtcagggtgatcgtcgtgcccgtgagcgcctggctgaccgggcagttcgccttggcgtcctcggcggccttgaggaaagcgtcctcgtcgagaccgggcacctcgcccacgacggtgaggtggatgccggtgatgcccgtaccgggctggaaggtcacctcggccttggtctccagccgggtcgacggggtgccggccccggcgagtccgtgggagagcgccatcgagaagcagctggagtgggcggcggcgatgagctcctcggggctcgtcttcccgttcgcctgctccgagcgggcgggccaggagacggggtagtcgccgatgccggaggagtcgaaggtgacgacccccttgccctcgatcaggttgccttcccagttcgtgtgcgcctgacgcgtggtagccatgctggatcccttcgaacggtgtgcgcggttgtaccggatatgcggttgtgcgggtgaacgcggttgtacgtacgggatatgcggttgtacgggatatgcggagcgcgccgtcgtgcgccgtgctccatcgcgttacgcccccgaacctactgcgccaccagccccttcgcgtcacgcgccagcgccgtcagccgggagatcgcccggaagtacttcttccggtacccgccgttcaacatctcgtcgctgaacagccggtcgaagggcagacccgaggcgagtaccgggacctcccggtcgtacagccggtcggccagcaccaccaggcgcagcgcggtcgactggtcgggcaccgcgctcaccccggtcaggcagaccgcgccgatgtcgtcggtgagcgcgccgtaccggctcgggtggacccgggacaggtggtccagcagcccggggaagtcgtcgagggacgcgcccggagtggcgtacgcggcccgggtgacctgctcgtcgtcgtacggcggcggggcctcgggcagaccgcggtgccggtagtcctcgccgtcgatgcgcagcgggcggaaatgcgcggacaggccctggatctcgcgcaggaagtcggcggcggcgaaccggccctcgcccagcttgcccggcagcgtgttcgaggtcgcggcgagcgccaccccggcctccacgagccggctgagcagtgaggacaccagcacggtgtcgcccgggtcgtcgagctcgaactcgtcgatgcacaacagccggtgcccgctgagggtccgcacggtctgctggaagcccagggcgccgaccaggttcgtcagctccacgaacgtgccgaacgccttcagcgacggctcggcgggcgtggcgtgccagagggaggccagcaggtgggtcttgccgacgccgtagccgccgtcgagatacacgccgcgcggcccggccggagcggccggcttcttgccgaaccacctgcgccgcccggcgcccgtcgcgtgcgccccgccgagcccggcggcgaagtccgccaggaccgtgaccgcctcgctctggctgggctggttcgggtcggggacgtacgtgtcgaagcgcaccgagtcgaagcgcggcggaggcaccatctcggcgaccagacggtctgcgggaacgtgcggctcacgggcgcacagggacagcggggccgtttcggcaagggggctctgccccggaaacgcggtggatgacgacacaactctccaccctaaggctcatgccagactgctacccatgcgaagcctgttccctgtgacggacctgacaaagagcgcctcgggagcggaggacccgtccgggccgcccatcgaccgcgagtggagcctcgacgagctggcggacgcctacgcctacccccccggcccctcggccgaagagaccgggaccccctggctgcgcgccaacatggtctccaccctcgacggcgccgcccagcacgacggccgctcgcagggcatctcctgcgcggccgacatgcggatcttcggcaccctgaggggtctggccgacgtggtgatcgccggggccgagaccgtacgcctggaggggtaccgtccggcccgcgcccgggaggcgttcgccgcgcggcgggcggccgccggacagggccccgctc

SEQ ID NO: 3986 - DNA, 575 bp, Unknown
  Kingdom: Bacteria, Phylum: Actinobacteria, Class: Actinobacteria, Order: Streptomycetales, Family: Streptomycetaceae, Genus: Streptomyces
  misc_feature (141)..(142): n is a, c, g, or t
cgctcccccatgccgatgtgcgaggtggccgtgatggtgagctcgaccatgtcgaggtcaggggtgcgggagacggccgaggccttgagggcggtcgcgtcgccgaccttcgccggggccagcatcacgccgtcggagccnnacgatctccagcgggatcttcgtggggtcgcggaaccacaggaggctccagcgctccgtggcggcggcctggcaggccacctccagggtcgcggcgtccacgatttccacgtaccggccgaactccacaccggggtggcgcgcggccaggaccgcgggctcgccgtgcttctccggcgtgacgatcacgatgtcggcctggccgaagtcctcggggagttccgggccgtcggggaagagcaccttcttcacggtcggcgggaggtccgccaggtccgcggcggaggacgccaccacaccgtccagccgctggtgcaccgcctcctccaggacggcgggggtgaggtcgttcttcttgcgcagatcgagccagcagagcttcatggtcctcttcctcgatgggatccggatggagcgaggtggtgacgcggtgg

SEQ ID NO: 3987 - DNA, 851 bp, Unknown
  Kingdom: Bacteria, Phylum: Actinobacteria, Class: Actinobacteria, Order: Streptomycetales, Family: Streptomycetaceae, Genus: Streptomyces
ggtcacggcggccgtggacgccagcgccgccgtgaccgggttgaccccggccccgaccgccgccgcgaccaccagcgggaccagcacggaggaccgggcggagcgcgactggagcgccagatgggcggccgtgctgacgacgaccacgccggtcaggaacatccaggggggcgtggacgcccccaggggtatccagcccaccagccagtcggccgcacccgagtcggagagggcgacgcccatcgccatggtggcggccatgaacagcagcagcggccagggaaccgtccgcagaccgtccttgaatcgcacggtccccagcgccggagaggtcgccaccagcgcgccgatgagcgcgaccacggcgggcgacaccccgtgcaggggctcgctgcaccacagcaggacgaccgtcgccagcaggagcagacaccgggactccgccggggtgaacggtccctcgacggccgtctcggagtgcttctggatctgcgccgccgtgatggtgaccggacccttgcgatcggaccgccgggtcgtcgtcaacagcacgagctcggcggcgagatgggaggagacgacggccagcggcagtccgaggacgagccactgcacgaagctcagctgctccccggtctgctcccagagcaccccgacggtgatcaggtgcgcccccgcgccgatcagggtcgcgacggccgacagcaggatgaccgtggggaagagcagcgccagcatcaccaccagacggccgcgctcgcgcagggcggctgccagcgccaggaacaccgggagcgcgagggcggcgcgccccgaggtggccggcacggcgaacgcggtgacgaccagac

SEQ ID NO: 3988 - DNA, 1327 bp, Unknown
  Kingdom: Bacteria, Phylum: Actinobacteria, Class: Actinobacteria, Order: Streptomycetales, Family: Streptomycetaceae, Genus: Streptomyces
gacctggtccgcactctcccccgcgtcgatccgccgccagttctccagggccaggatgcgcaggacggcgacgatctgcccggccgcgagccgctcgggcagcccgtcgccgagggcgcgggcgagcgccgcctcggagcggccctggtaggcgtgcatgcgggcgaccagcgacggcgtcccgtacaacaggcggtggaacttcagcacttcgggtacgtcgcagaggccggtcaccgggtcgcggcggtcgaggccgtcgaggaagtggcggcgcagggcgtccagcggaccctcgccgaggcgccgttcggcgaccacccgggcggattcgtcctcgtggtcggcgaaccggtgcagcaccaggtcctccttggcggggaagtaccggaagagcgtcggcttggagatgtccgccgcggccgccacctccgccacggacaccttgtcgaagccgcgctccaggaacatcgcgatggccgcgtcggagaccgcctgataggtcagccgcttctttcgctcccgcagcccgggcccgcccccggctttctctccgctcatgaccatgaagcgtacgcccccgacctcaagcggacttgacgtcgccgccggtggcgccggagccgtcggagccgtcggccgccctacggatcagcgcctccaccccgtccagcagcacactcatgccgaagccgaactcgtagtccgcctcgtccggctcgctcatgaccccggtctccagctgccgggtgatcccggggtgccgctcggggtcgacgagccgcttgagggtgcgttcgtgggaggccatcaactcctcgggagtgatgccgcgcgcggtgacggcggcggccaggtcgctcatcatcagcgcctcgctgcgcacgaagttcgagaccagcaggatcaccgaggtcttgtcgccctcgccgagaccgctgccccccagcgcctggagcccctgttcccaccaggcgatcgagttcggggtcgcgggcgggccgccgatggggatccggagggcccagaggtgcgcgtgatagcgctcgcgctgcgcggaggcccattcggtgagcgccctccgccagcccgcaccggcctccagggctgacaggggttccggcgggccgatggccgcctcctgcatcaggacgtacagctcgtccttggcggagacgtaccggtacagggacatcgtggacgcgccgagctcctgggcgacccggcccatcgacacggccgcgagcccgtccgacgccgcgacgcgcaccgccgcggccacgatccgctccaggctgaggccgggcttcggacccttggccgggcg

SEQ ID NO: 3989 - DNA, 1933 bp, Unknown
  Kingdom: Bacteria, Phylum: Actinobacteria, Class: Actinobacteria, Order: Streptomycetales, Family: Streptomycetaceae, Genus: Streptomyces
tcggcgcccgcgtcaccgcggtggacatcagccgccgggccgtggcgtccgcacggctgaacaccgcgctcgcccgcctgcccgtcaccgtacggcggggggacctgctcagggccctgccgggccgtacgttcgacgccgtcgtcagcaaccctccgtacgttccggcccccggcccgacggcaccgcggcacggggccggccgctcctgggacgcgggacccgacggccgggtcgtcctcgaccgcatctgcgacgacgccttcgccgccctgcgtcccggcggtctgcttctgctggtccagtcgggactgagccgacccgaggagaccgtcggccggctctccgcagctgggctggacgtctccgtgaccgacagggtgacgatcccgttcggaccggtcacccgccgccgggccgcctggctgcgggcacggggtctgctgcgggaccgcctggacagggaagagctggtggtgatccgtgcccggaagcaatgagacgccgcgccgcgtggtgatgaaccgggaaggcccgatcctggtggaagggccggtcgaggtcgtgggcgacgacggcacgacgacccggtccgaccgtttcgtcgtcgcgatctgcacctgccgccgcagtcgcgtctacccctggtgcgacaccagccaccgccgccgcaagcacgccgggccctccggggccccgcacggcggccgacagccccagcagggcgaggaggagtcccgaccgtgacgaccccggccaccaccccacaccggagccccgcggactctcccggacttccccgggcccgcggacccctgagcgggagcgtcctcgccgtgctggcgggcggcggaacccgcctgcccgaaaccggtgcggtccgcgcctgcgacccgtacggggacgacctgcaactgctcctgtacgtcctgtacgagctccactaccgggggttcgcgggcgtggacgagcgcctggaatgggaccccgccctgctcggcgttcgcgcggcggccgaggaggtcttcctggacgcgctgcgccgtgacagcggcccgggcgggaacgacgtggcggaggcggtcgacgcgctccagctggaacccgtcggggacgacggccacagcgtcagccactacctccagcgggagggagagctgtggcagctgcgcgagtacgccgccgtgcgctccctgtaccacctgaaggaagccgatccgcatgtgtgggtggtgcccaggctccgcggccgggcgaaggcggggatggtcgccgtggagttcgacgagttcggagccggccgggcggaggacgtccacgcccagctcttcgccgacctgatgaccgacctcggcctcgacgcgcggtacggccgctacctcgacgccgcgcccgcccaggccctggccaccgtcaacctgatgtctctgttcgggctccaccggcggctgcgcggcgcgctggtcggacacttcgccaccgtggagatcacgtcgtcccccgggtcgaggaggctggccgaggcgctgcgccgcgtgggcgcgggtgtcgacgcccagcggttctacgacgagcatgtggaagccgacgcggtccacgaacaggtggtgcgccacgaggtgatcggcggcctgctggaggacgagccggggctcgcggccgacatcgtcctcggcatcgaggcgaccggccacctggaggacctcctcggggaccacctgttggcggcgtggcgtgacgggcacaccgcgctgcgcacacccctgacgcctgaaagcctcgcgtgacgccctgagagcctcgcgtcagccggggttcggaccgaaggggctctcgtcgagacggtcgagcagctcggcgacgtcccggtagaccgcctccgctcccgcccgctccaggtcggcgcgcgggatgccgcccgacaggagggcca

SEQ ID NO: 3990 - DNA, 2289 bp, Unknown
  Kingdom: Bacteria, Phylum: Actinobacteria, Class: Actinobacteria, Order: Streptomycetales, Family: Streptomycetaceae, Genus: Streptomyces
cgttccgtccggcgccccgcacaccaaccgtcccgctaccgggcggggcgtcggacggaacgcttcaccccgtttttgtctctgtgctcgacaccgccgcgccttcccccgggcgcggcatccccgccggtcaggcggcgaaggagatggttcatgtgtccgctacgcccgtgttggcgttgcgaggggtctccaagcgcttcggtgccgtccaggtactcaccgatgtagagcttgaggtccacgccggcgaggtggtcgccctggtgggcgacaacggcgccggtaaatcaacgctggtcaagacgatcgccggagtgcaccccatcgatgacggcgtcatcgagtgggagggcagggccgtgcagatcaacaagccgcacgacgcccagaacctcggcgtcgcgaccgtctaccaagacctcgcgctgtgcgacaacatcgatgtcgtcggcaacctctacctcggccgggagctccgcaggttcggcatcctggacgaggtcgagatggagcgccgctcccgcgagctgctgtccacgctctccatccgcatcccgagcgtccgcatcccgatcgcctcgctctccggcggccagcgccagaccgtggccatcgcccggtcgatgctcggcgaaccccggctcgtcatcctcgacgagccgaccgcggccctcggcgtcgagcagaccgcccaggtcctcgacctcgtcgagcgactgcgcgagcgcggccacgcggtcatcctcatcagccacaacatggccgatgtgaaggccgtcgccgacaaggtcgccgtgctccggctgggccggaacaacggtgtcttcgatgtgaagaccacctcccaggaagagatcatctccgccatcacgggcgccacggacaacgccgtgacccgacgtgcggcgcgcaacgcggaggtttccaagtgaccaccgacaagtccgccacctcgctggacaaggccgacgccacggccgaggcgccgccggtcggcaacccggacgcggccgagggcgccgccacggtcgtcgacccccgcctgctcatccgcgagcagggtctcggcggctacgtcaccgagttcaagcgcaagatcagcggcggcgacctgggctcgatcccggtgatcgtcggcctcgcgatcatcgccatcgtcttccagagcatgaactccgagttcctctccgcgaagaacatcagcgacatcgccaccacgatggtcgccaccggcatgatggccgtgggcatcatcttcgtcctgctgctcggcgagatcgacctctcggtcggctccgtctccggtgtctcgggcgcgctcgtcgcggtgctcagcgtcacccagggaatgaacgaatggctggcgatcctcgtcgccatcgtcagcggcgcggtgatgggcgcgatccacggcttcttcttcgcccgggtcggggctcccgccttcgccgtcaccctggcaggcctgctgttctggctcggcttcatgcttcagctgctcggtgactccggcacgatcaacctggacggcgacggggtggtcggcaagctgaccacgtactacttcaccgacgtcgccgccgcctacgggctcgccgccatcgcggtcgtcggctacttcgccgcggccttcctggacacccgtcgccgcgaggcggccggcatcccggcccgcccgctcgccgacatcctcgtgcgcaccgcggtcatcgccgtgttcggcttcgccgccgcgtacatgttcaaccagtaccgcggcctgccgctggccctggtcctcttcctgatcgtcctggtcggcacggacttcctgctccgccgcacggcctacgggcggaagatcttcgcgctcggcggcagcgtcgaggcctcccggcgcgccggcatcaacgtcaccgcgatccggatctccgtcttctccatcgcggggaccttcgcggcgatcggcggcctgttctgggcctccaagatcgcggcggccaaccagggctccggcaccggcgacctcctgatgaacgtcatcgcggcggccgtcatcggcggcaccagcctcttcggcggccgcggccgcacctggaacgcgctgctcggcgtcatggtgatcgtctccatccagtacggactgtcgctggagggcatcgccacgccgatccagtacatggtcacgggcgccgtgcttctcgccacggtcgtcatcgactccgtcacccgtaagacccagaagaccgcgggccgcgcctgaccgcacgtctgcgcaggcgcccggtgcccccaggggtgccgggc

SEQ ID NO: 3991 - DNA, 603 bp, Unknown
  Kingdom: Bacteria, Phylum: Actinobacteria, Class: Actinobacteria, Order: Streptomycetales, Family: Streptomycetaceae, Genus: Streptomyces
cccgttcgagtgagccgggcgctgtgagccgggcgccgtgaccaggacaccgtgagccggacaccctccgggcgccgcgattccggtggaccaggtcagtgggcgagccggctgccgccgcccggggctccggtgctcgcctcgaccagggcgtccaggaccgcttcgacgtccgggagccagggcgccgcgaccgcgggagccccgtccttcgcccgcccgtgggagaccggggctgcgtcggaggcggccccgagcggtgcggggggccgctcccagcggacctggcccgtgccggtccgggacggcggcaggacgagatagcctccctcgccgtggaaccggagcgagctgggcacccagtccttcgcgtacagcagttcgccgagccgttccagggtgtacggggccaccagaagcgaccaccgggtgggcgtcgccacgacggggccgagccgcatgccgaggacgtcgagggcgcacagcgctctggcgcctgccacggcgggcaggctcaccgcgcagggcgcacggccgccggtcgccaccacggacgagcgcatggtgcgctggtggtggacccaccggcccaccgcccccgtc

SEQ ID NO: 3992 - DNA, 688 bp, Unknown
  Kingdom: Bacteria, Phylum: Actinobacteria, Class: Actinobacteria, Order: Streptomycetales, Family: Streptomycetaceae, Genus: Streptomyces
acgtcctggtcaacaacgcgggcacggctgcgctggaacgcttcaacgagatcacccccgcgagttggtcgcacatcatgcgggtcaacgtcgacgccgtcttcttcctcagccagcgcatcgccgaacacatgacggcggactcggtcgcgggccgcatcatcaccatcacctcgaagaacgccctggtggcggaggccggcctggcccactacaacgcctccaaggctgccgcccaactgctcaccgagaccctggcggtcgaactcgccccgcacggcatcaccgccaacaccctggctcccggcatggtcgagaccccgatcgacggcgaattccccctcgaccgggaggccttcgaatccgcgtaccacgagcgcatcccgctcggcaggtacgcgcagcccgacgaatgcgtcggcgcgctgctgctgctcgcctcggacgccggggcgtacctcaccggggcgcgcatcgtcgtcgacgggggagtgctggccgaccagatgccgcgtatgcgcttcatgccgccgtaccgcaacacgatctgaccgcgaccgaccggcagtcggttcccaccgagcacgcatcgacaacgcgaggagcgcctccgccatgtccgtccatgcatcgtcctgcgccccggcctccgcttcgtcccgccggagtctgttgcgggcttcggggc

SEQ ID NO: 3993 - DNA, 935 bp, Unknown
  Kingdom: Bacteria, Phylum: Actinobacteria, Class: Actinobacteria, Order: Streptomycetales, Family: Streptomycetaceae, Genus: Streptomyces
ctcgccgccctgcgctccggcgactccggcgcgctcgcccaggccctgagcaacgacctccagcccgccgcgctctccctgcgtccctccctcgcggagaccctggccgcgggcacggaggcgggtgccctggcggccctggtctccgggtccgggccgacgacggcgttcctggtggaggacgagtcggcggcccgcaaggcggccgacgcgctgatggcctccgggacgtgccgcgaggcgcgcacggcgatctcgcccgccccgggcgcgaaggccgtctgacctccgcacccccggaccgctcgtactcaccccggatctgagtacggtcgcgctgccgcgccccgccctgctcgcgcgaccgtacgtccatgggatcaagtgttcgtgaactggccggggcgacgcccgccacccgggaccgctacgtcgacctgctgcgggtcgcctcgctcggcgcggtcgtgctcggccactggctgatggcggccgtcaccccggacggggtgggcaacctgctcgccgtcgtcccggcgctccagccgctgacctggctgctccaggtcatgccggtgttcttcttcgtcggcggcttctcccacgcgctgtcctaccgctccctgctccgcaaacggcccgaggggtccgagcggtccgtctactcggccttcctccgcgcccggctccagcggctgctgcgcccgaccacggtcttcgtcctggtgtggggtgcggcggcgctgctggtccaactcctcggcgggggcggcggactgaccggcgtcaccctgcgcatggtgacccagccgctctggttcatcgggatctacctggccatggtcgcgttcaccccgccgctgctgaagctgcacgagcggtacggctgggcggccttcgccgggctggcgggcgcggcgaaggccgcccagccg

SEQ ID NO: 3994 - DNA, 1981 bp, Unknown
  Kingdom: Bacteria, Phylum: Actinobacteria, Class: Actinobacteria, Order: Streptomycetales, Family: Streptomycetaceae, Genus: Streptomyces
agcgcggcggcggcacggtgaccatcccggcggggacctaccgcatcgacgacgtcatccgcatcggccacagcgacgtcgtggtgcgcggcgcgggcagcggcgcgacgacgctgtacgcgacccgaagcctcaccgagctgatcggcgtctacggcagccgctacggcggcgacaagtccagctggtcctgggccggcggcctcatctggctctgcccgaaagagcgttggacctcgctgaccgacgcgatccgcgcccgggagtggcctttcgagggctggaccggcaaccgccgcgacgactggcgcaccctcgcgaccccggaccccggccgccggggcgaccacacgatcaccgtccccggcgccgacgcccgccggctggagcgcggacaactcgtcctcctccgcctcgccgacgaccccggacacacgctgctccagcacatggcgggcgacggcgagggcgcgcgggcgtacgcgtgggccgacaagaccaagctgacctcgtacgtcccctacgaatggccggtccgcatcaccggcgtgcggggccgccggatcaccctggaacgcccgctcccgctcgacctgcgtcccgcgtgggacccccggctgaccacgctcgtcaccccgctcaccgggtgcggcgtcgagggcctttccctggaggcggtcgagaagccgcaggccccgcacctgctggaccaggggtacaacggcgtcgcgttccagtgcgcgtacgactgctgggccgacgacgtgaccgtccggcacgtcgacaacggcttcggcctgatcggcgcgtccgcctgcaccctgcgccgcacgaaggtggagggacgtggctcgcaccacccgtactactgccgcgagggctcgcacgacaacctgatcgaggacttcaccgtcgtcgcgcgcaccacccccgcgccccccggcacccagctccacggcatcaacgtcgaaggcctgtccagctacaacgtctggtcgcgcggccggatggagatgggcacgttcgactcgcaccggggtatgccgttcggatgcgtccgcaccgacatcacggtcgacaacaacggcgtccacggcggcgacgcgagcgcgggacccctcttcggcgcgcggttcacgcactggaacatccgggtcgtcaacgaacgggccgggctgatgaggatcgacggcctcgccccgtacagcgcgaccgtcggcatcagcgaggtgcgggagttcggccagatcgacgtccccgacttcaccggcgacctgcacacccgcctggaggcgtacgggagcccggaggcggtccggccggccaatctgtacgaggcgcagcgggacgtgcgcctgcgctgaggtccgtcagccgctcttccgcaccgcgtccagggcgtcgacgaggtggggcgcgaccagctcccaggtctcctcggcggcttcgggtccgacggcgcggggaacggtctcgaccagcatgatgaggtagaggtagctccggtacagcgcgtagcgggtccgcagcgagtccgtgaactccaccgccgcgccggtggatcgcgcgtacccgtcgaggaagtccccgtcgcgttcgatgtccgcgaagagcgcgagggaggcgaagtcggccaccgggtcgccccagaacatccgctccccgtcgatgatcccgccgatggtgcgtgcgccgggctctcccgtgaccagcaggtttcccggccacaggtcgaagtggacgagagcgggccgggtgacgtcgtccagcacgtcggccgcgtccgccagcaccgtacggatgtggccgacggggtacggcagccgggcccggtaggcctcggcgtcggccggttgcactccgtgaccggtcccgccggattcggctatcccgccgagccgttcgggccgttcgccgccacctggcgggccgcgttcaccgcgatgaccgaggccgtgctcgccgacgccgaggcctaccg

SEQ ID NO: 3995 - DNA, 2189 bp, Unknown
  Kingdom: Bacteria, Phylum: Actinobacteria, Class: Actinobacteria, Order: Streptomycetales, Family: Streptomycetaceae, Genus: Streptomyces
gtccaggacgacggcggcctgggcggcgaacgcgccgagcacccggcggtcctcggcgggcagcacccggccggacagcgcgagggccatgttgtcgccgaccggcatgtccacgtcggcgtcgtcgggacgcgtgaccggcgccggcccgacggatccggcgcaggtccacggttcgacgtcgctgctgcgctccagcagggcgacggactccatggcgaaggtctcgcggacccgttccagcagggcgtccagggcggtctcgccgcggagcacgctgcccgcgaggaaggagaggatctccgactcggcgcgcagccgggcggcctggtgggtgcgccgggccgcgaggtcgaccacggaggagaccgccaccgccaccgcgaagaagatcacgatggcgacgaggttctccgggtcctggacggtcagcgtgtgggtgggcggggtgaaccagtagttcagcagcagggagccgacggccgccgaggcgagcgcgggccgcagtccgccgagcagggcggcggccaccgtcaggaagaggaagagcaggacgtcgttggcgaggcccggggcgtcctccatgccgcgcagcaccaccgcgagcaggacggggccgacgacgccgacgagccagccccagatgatccgggcgcggccgagccgggcgccgcgggccatgggcaggccgcggcccttggcgacctcctcgtgggtcacgatgtggacatcgaggtcgggccccgactcgcgggcgacggtcgcgccgaccccgggtccgtagatgtactgccaggtcttgcggcggctggagcccagcacgatctgggtggcgttgacgccgcgggcgaactccagcagggcggccggtatgtcgtcgccgatgacgtggtggaaggtgccgccgaggtcctcgaccagggtgcgctggacggccagctccttcggcgacgcagaggtcaggccgtcgctgcgggcgatgtagacggcgaggatctcgctgccggagcccttggccgccatccgggaggcgcggcggatgagggtgcgtccctcgggtccgccggtcagtccgacgacgatgcgttcgcgggcctgccaggtggtgcggatgttgtgctcgccccggtactgctggaggtactcgtcgacccggtcggcgacccagagcagggccagctcgcgcagggcggtcaggttgccgggccggaagtagttcgagagcgccgcgtccatcttgtcgggccggtagatgttcccgtgtgccatccggcggcgcagcgcctggggcgacatgtcgaccagctcgatctggtccgcccggcgcaccacctcgtccggcaccgtctcccgctgccggaccccggtgatcgactccaccacatcacccagcgactccagatgctggatgttcaccgtggatatgacatcgatcccggccctcagaagttcctcgacatcctgccagcgcttcgcgttgcgcgaaccgggaacgttcgtgtgcgccagctcgtccaccaacgccaccgccggagcccgctccagcaccgcgtccacatccatctcggtgaagaccgtgccccggtactccaactcccgacgcgacagaagctccagcccgtgcagcatcacctcggtacgcggccggtcatgatgctccacgaaagcgaccacgcaatcggtgccgcgctcgaccctgcgatgcgcctcggagagcatcgcgtacgtcttgccgacgcccggcgccgcgcccaggtagatccggagtgtgccgcgtcccatggccccattgtcttcttccgtccggtcctgtcgtgtcgacggccggtggcgcccggtgcggctgccgtcctcgacgctactccgccgcgggccgtggttcggtcccgggagtgcaggtggggggcgtattgacggaactctgatgcgcgccggggtgggtgctgggacgctacgcggcgggtgcggggtgcgctacgggaacgtcagccgtgctcgacgatgtggccgtcgctcagctccaggacccggtcggcgaggcccagcagctgggggtcgtgcgtggcgacgagggcggtgacgttctcgctgcggacgaccgcgcggagcagttccatcacggcgagcccggtctcggcgtcgagctgtccggtgggctcgccgtgatggaactgctccgcgcggtcgtc

SEQ ID NO: 3996 - DNA, 3030 bp, Unknown
  Kingdom: Bacteria, Phylum: Actinobacteria, Class: Actinobacteria, Order: Streptomycetales, Family: Streptomycetaceae, Genus: Streptomyces
gccgtggcggcggccgaggccggagtcgcccatgccgcccatcggggcgtcgacgcttccccatgcggctgcgaaggcctcgttgacgttgacggttccggcgtgcacgcgtgcggcgacggcacggccccgggctccgttgcgtgaccacacgctggcgttgaggccgtaagaggtggcgttggccagggtgacggcatcctcgacatcccggtaggtgtagatcgagacgaccgggccgaaggtctcgtggtcgtacagggtcatgtccggggtgacgtcggcgaggatggtcggctcgtagaagagcgggccgaggtcggggcgcgccctgccgccggcgaggacggtggcgcccttggcgacggcgtcgtccacgtgctccgtgacggtcttgagctgggcgggggtggtgaggctgcccacgtccacgctgtagtcgtacgcggcgccgatcgtgagcttctgcacccgggcggtgaacgcggcgacgaactcgtcgcggatggactcggcgacgtacaggcgctcgatggagacgcacagctgaccggcggaggggaagcaggcggcgacggcgcctgccgccgccttctcgatgtcggcgtcgtcgaggacgatcatcgggttcttgccgccgagttcgagggaggcgccgatgaggcgcctgccggcgttgctcgcgatcttgcggccgctggcggtggagccggtgaacatcatgtagtccgcgttgtccatcagcgggtcgccgatggagctgccgcggccgatgaccatctgccacacgtcccgggggagcccggcctcgtacatgaggtccatggaccacagggcggtcagcgcggtctgggtgtcgggcttctggacgacggcgttgccggccatcagcgccgcgatggtgtcgctggcggccatgctgagggggtagttccagggcgagatgacggtgacgacgcccttggggtggcgcagttcggtggtgtgcgtgagcagcgggatcgcaccgcggcggcgtttcgggccgaggtacttggcggcgttacgggcgtagtaccgggagacgatcccgatgtcgacgacctccaggaaagcgtcccggcgggtcttgccgttctcggcctgcatcaggtccagggcctcgtcctgacgtgccagaacgaggtcgtggtagcgcagcaggatcctcttgcgctcggcgatcggcgtggcggcccaggacttctgcgcgacccgggcgcgggcgaacgcgttctcgacgtcgcccggtgtcgagaccgggaggtcggccaggggaacgcctgtgtagggggcactggttgtgacccgtccggcgtccgacgcggccgcgaccagtgcggtcagccgtcggagcagggccggagtgatggattccggcagggccgcgacgggggtggccgtggggcgggttgcgtgttcagcgctcatggcggggctccttgctcacttgttccgggacgggaccgaagtggggaccggcatgtgcagggcgagctggccctcggtcatcacgtcgaactggacggtcctcttcggcttgagcgagcgcaggtcgtccgccatgcgcccctcgccgatctggaggtcgatgccgctcctgctgcgtgtcgtaccggcgttcagcacgttggtctggctgagggtggagtgccaagcgccgttgatcgacgtgtacgaggtgagggaggagacgcgctccccgctggggtgagcggtctgcttcggcgtggccgccgagagcgccaggtccacgccgccggtgtcgttggccacgcgggcggtcgtacggttgccgtcgatgtcgacatcgaggccggtgacccacttggggaagccgtaaccgtcgtggccgcggacctgcgcgatctccgtgctcacgggcagggacagcacgtaggagtcgagatgctcgttcttcaggccggagacgaggtcgaagaagccgagcttcccgtgccgggccggtttgacggcgataccgacggcggcctcggtgtagaagtcgatgtcgcacacgtcgtatcggaagaacatcaccgagacgagcccgaggcccggggtgagttccagcggtgccagttcctccggcagccgggcgcggatcgcgcgggacggcgcgagcatcgtcagccgggcggtggagaccgtgtagtagaagttcggggtcagcgtggggccgatcggggagtcgaccttgatcttgggtagctgccggaagaagtgcacgccgctgacgcgcgggtcgcgggcgatggcgtcgaggtcggggttcatccggtaccggtcgtagaggccgcccttggggacagtgacctcgcggcctccgaggtcgaccttgacggcgtcgttgtccttctgtgtggaaggcatgatgcgtgtcccttcgatgttagcggcgtatacatgacggtagggtgcgatgtttgcgatgtcaacacgtgggtgaggtgactcgggggtggatctgaccgatcggcggagcacgggggcagtggtccccggtggatgggcacacgctgcgaacggacgctcctgccctcggtcaggcgggcttcaccggttttccctgagacgtcggtgcgcggcggtgaggatgctcgaccacacggtggccacggctccgggaagagcggaatcctgctgctccgcctcgctgtccgcgccctcctcgccgggcgcgatcgatggcggcctcgccgaggccgtgggaaccgccggcccgctgccgctcggctctgcgtcgtccatcgttcgggtgttccccgctcaggccgcgttccgtgacttcgccagccaggtgcgatagcggcgcagagcggttcgctgcttgcgctgttcggagaccagggcaattgccgggtgggtgccgggcctggggtcggcgccgcgggcgaggcggcgcatctggtggcggacctgggccatgctcgcggcggaggcgagggccttgtcggaccaggtcaccggacgcatggggcggtcggcctcgcggctccggcgccagcggtc

SEQ ID NO: 3997 - DNA, 692 bp, Unknown
  Kingdom: Bacteria, Phylum: Actinobacteria, Class: Actinobacteria, Order: Streptomycetales, Family: Streptomycetaceae, Genus: Streptomyces
gcaaccagcccccgggttacccctccgaccagacggtctaccactacttcgcggtgatcggatacgacacggactacaacacggtgtgcatcgccgactccgcgtccttcaacggctggcagatctactggttgaacttctcccagctcgccggcctcatcccgcccaagggctacgcggcctgacctcaccgcccggaccacgaccgcccgcgccgcgggatcacacctgcggcgcgggcgggacgcaccggctcagccgcgtcggatgcgtgacctgtctccgatgtcagcgcactcatcgagcccgtatgcgccgaaaaatccggctgcgagcgtctacgcccgcatgacctcctggcacaccggatcgacctggctcgccgacaccggtcccggacgctcctccgggccttcgaccattcccatccggcggacaacgctcctggctcgtcccgcgattgtgcgcgcgagcggtggctgtgcctctctgcctcagggggaggggtgcgcctatctcgtcggcgtcaccggtgctgcccgcggcgccctgctgttgaccgcggtctaccgctaccgcaggcactcggagcagatgacggctcagcctgagtatccggcgatggagctgcgcgctcacccgtccgcctggaatcacggcaaacccgtggagcaactgcgcaaggagacgtg

SEQ ID NO: 3998 - DNA, 3156 bp, Unknown
  Kingdom: Bacteria, Phylum: Actinobacteria, Class: Actinobacteria, Order: Streptomycetales, Family: Streptomycetaceae, Genus: Streptomyces
ggcggcggccgccgcctcgtggagccgggtgcgcagggcctcgtccaggccgggggcgggggcctcctcgatgaccttctggtggcgacgctggagcgagcagtcccgggtgccgagcgtccacacggtgtcgtgctcgtcggccatcacctggacctcgacgtgccggccacgctccacgtacggctcggcgaagacctcgccgtccccgaaggcggacgccgcctcggcggctgcggccagcagttcgcccggcagcgcgccgagttcacggacgatccgcatcccccggccgccgccgcccgccgccgccttcagcagcagcggcagatcgtcctccccggccgtcgccgggtccacgggggccagcagcgggactcccgccgcggccatcagctccttggcccgggtcttggacgccatcagctcgatggccttcaccggcggacccacccacaccaggcccgcgtcctgcacggcggcggcgaaggcggcgttctcggagaggaagccgtacccggggtgcacggcgtccgccccggcggccagcgcggcggccacgacgagatcgccgcgcagataggtgtcggcgggggccgcgcccggcagccgtacggcgaggtccgcctcccgtacgtgcagggcgccgtcgtcggcgtcggagtacacggcgaccgtggtgatgcccaggtcgcggcaggtgcggaagatccggcaggcgatctcgccccggttggcgacaagaagcgtggtgatggtcatccgggtcccgtgggtggtgatggtcatccggccctcacattcggaagacgccgaagccgccgcgggcgccctcgaccggtgcggtgtggatcgcggacaggcacatgccgaggacggtccgggtgtcgcgcgggtcgatgaccccgtcgtcgtacagccggccggacaggaacatcggcagcgactccgcctcgatctgctgctccaccatcgcccgcagcccggcgtcggcctcgtcgtcgtacggcagccccttggcggcggcggaggcgcgggcgacgatggacaggaccccggcgagctgctgcggacccatgacggcggacttgctgctcggccaggcgaagaggaagcgcggatcgtaggcgcggccgcacatgccgtagtggccggccccgtaggacgctcccatcaggaccgacagatgcgggaccttcgagttggcgacggcgttgatcatcatcgcgccgtgcttgatgatgccgccctgctcgtactccttgccgaccatgtagccggtggtgttgtggaggaagagcagcgggatgtcgcgctggttcgccaactggatgaactgggcggccttctgggactcctcgctgaacagcaccccttgcgcgttggcgaggatcccgaccggatagccgtgcagccgcgcccagccggtgaccaggctcgtcccgtacagcggcttgaacgcgtcgaagtccgagccgtcgaccaggcgtgcgatgacctcgcgcgggtcgaagggcgccttcagatcgccgggcacgatgccgagcagctcgtcctcgtcgtacttcggcggctcggccgggaccggatcggcgtgcgccttgcgccagttgaggcgggcgacgatgcgccgggcctgacggatcgcgtcctgctcgtcgacggcgaagtggtcggcgagcccggaggtgcgggcgtgcatctcggccccgccgagggactcgtcgtcgctctcctcgccggtcgccatcttcaccaggggtggtccgccgaggaagaccttggaccgctccttgatcatcacggcgtggtcggacatgccggggacgtacgcgcctccggcggtggagttgccgaacacgacggcgacggtggggatgccggcggcggagagccgggtgatgtcgcggaagagggccccgcccgggatgaagatctccttctgggacggcaggtccgccccgcccgactccaccaggctgatgcagggcagccggttggcgaaggcgatctcgttggcgcgcagggccttcttcagcgtccacgggttcgacgccccgccgcgcacggtcgggtcgttggcggtgatcaggcactcgacgccctccaccaccccgatcccggtgacgagcgaggcgccgacggcgtagtcgctgccccaggccgccagcggagacagctccaggaacggggtgtcggggtcgacgagcagctcgatccgctcgcgcgccgggagcttgccgcgcttccggtggcgggcgacgtacttctcgccgccacccgcgagcgccttggcgtgctcggcctccagctcggcgagcttggccaccatggtggcccggtgcgcggcgtattcggcgccgttggtgtcgaggccggtgggcaggacggtcatgcggtctcctccgggagggggacgccttccagcagcggtacggggacgggcagcgaccgggaccgcagccactcccccagcgccttggcctgcgggtcgaaccgggcctgggcggcgacgccctcgcccagcaggccgtgcacggtgaagttcagtgcgcggagatgaggcagcacgtgacgcacgacagtcaactcggcggtctccggcaggagttccctcagccgctcgacggtcagctcgtgcgccagccagcgccaggcgtcgtcgtcgcgcacccagacgcccacgttggcgtcgccgcccttgtcgccgctgcgggcccccgcgatcagaccgaggggtgcgctccgggtgggggtggcgggatacggctcggggagcggcggatcggcgagttcggccaactccctcgtacggacgggcggtttctgaacttccctccgtccgtcgggcagtacggcggtgtgctcgacgtccgccgccggtacgggcctggcctcgaacaccccgtagggcgcgccctttccgggcggagcggtgacatggaagcccgggtaactgccgagggccagctccacggcggccccggagaccgcgcggccgaccgcgtcggcttcccggtcgcggacgacgagccgcagcagggcgctggcccgctcctcggtggcggcgtcggcgtggtcggtccgggccagctcccagcgcacctcggccggcggtcggccgccgccccgctccagggcgtcggcgaactggtc

SEQ ID NO: 3999 - DNA, 3309 bp, Unknown
  Kingdom: Bacteria, Phylum: Actinobacteria, Class: Actinobacteria, Order: Streptomycetales, Family: Streptomycetaceae, Genus: Streptomyces
gtgcagggcgcgccaggcgtcgccggtgtcggtctcctccgcgacgaacgcggtcacgccgtcgtcgagccagccgcgcagccgctcggcggtcagatcgcgctcggggtcggcggagcggaagacggcggccgggccgccgggcagacccgcctcctccaggcccttgaggaagccgtgctcacggtcggtggaggcgggagcctcgtcgtcctcccggacgagcacgatgcgccggtggccgagctcggcgaggtgcgcgacgacttcctggctcgcgctgatgtagtccgcgccgacccaggccagcccctccagctcgtcccggcggcccaggtggaccacgggaaagccgtcggcgaccagccgcagcagttcgtcggcgggagcgtggcgtccgaggaacaggcagccgtcggccagccggacccgggagagcgcgttcggcccggcggcacccgcgccgcccgtgctggagccggtgaagagcaccaggtcgtagccgcgggccgcggcctcctgctcgacgccgaccaggaaggggtagtacgagtgctgcacgtcggtggggaaggtggacgtaaagctgaagaccccgagcagattgttccgcgcggccgcgaggcggctggccgccggatccgggacgtagcccagggcccgcaccgcgtcgagcaccttccgccgggtctcctcggagatcgtggcgccctgcttccgggcccccagcaccagcgagacggtggcctgcgagaccccggcgagccgggcgacctcggcctggcgcggacgggacgtacggcctgcgggggcgggcgcacggcccggcctggaccgcttcctgggttcttccacggtgttcctccggatcgctaatgcgtattactaatgcgcattagtgagtactgtgaacctccgtcccgcaggggtcaagggattgcgcaagacttctttcggccgtgtgggtgccgacccgtgcgtgcgcggcacggcgctcgccgggccccgcaccggctcaccagtcgtggacggtcccgtcgtggagacggttgaccggcagatacgcggccgcgtacggatgggtggcggccagctcctcgtcgagctcgacgccgatgccgggctcctcgcccgggtgcaggtggccgtcggtgaaggtgtaggcgtgccggaacaccgcgtcggtgagcgggctgtggcccgcgtactcctggatgccgaagttgtgcacggcgaggtccaggtggacggcggcggccatcccgaccggggagatgtcctcggggccgtggatcgcgctcctgatctggtactgcgcggcgaagtcgaagagcttgcgcagcggggtgacgccgccgaagtgggtcaccgccgagcgcacgtagtcgatcaactgctcggtgatcagggcctggtagtcgtacaccgtgttgaacacctcgccgacggccagcggcgtggtggtggaccggcgcaccaggcgcagcgcctcctggttctcggccggggtgcagtcctccagccagaacggccggtagggctccaggtccttgccgagccgggcggcctggatcggggtgagccggtggtgggcgtcgtgcagcagcggcagttcggcgccgaactccgcgcgcaccgcctcgaagacggccggcacatggcgcagatacgcggaggtgtcccagtcctccaccagggggcgggcctgctggtggagaaccgcggcgccggtgtcgtcggtgtccgacaccccgtacacggccttcaggccggggatgccggactggatgcggacggcggggtagccctcggcgagccgggcccgtacggagtcgagcagctcgggtatgtcccggccgttggcatggccgtacgtcccgatccgctcccggctcgcaccgcccagcagttggtacagcggcagcccggcggccttcgccttgatgtcccacagcgccacgtccacggcggcgatggcggccatcgtcaccgggccgcgccgccagtacgcgccccggtacagcgactgccaggtgtcctcgacgcggtgcgggtcgagcccgaacagcaggggggtgacatggtcggtgagatagctgacgacggccagttcccgcccgttcagggtggcgtcgccgaggccggtgagcccttcgtcggtcgtcagcttcagggtgacgaagttgcggccggggctggtgacgacgaccttcgcgtcgacgatcttcatgcgtgtgtgctcattccacaggtgggggagtggtgggggttcagcccctggtggcaccggacgtcagcccggccaccagatacttccagcagcgacgcggtcgccgttccgggggccgcgagcggcagcgagatacgccagaacgcgccgaaggcgctcaacccgtcggtgcggacggtctcctccagcttcatcggcagccccgcgaagaagctgatcatgatccacatgatcagcggcaccgagaccaacatatggctgaggatcagccggcgccgtgcgtggagaaccggcccaccgcccaggccgtcggtacggcgatcacggcggagaacaccatcgaacccgcccccaccagcagggagttgctcatcgtcgcacgatctgcccggcctcgacgaccgcgcggaagctgtccagcgtcggggtgaaccacagtccgaccggggggatccgtgacctggacgtcggtcttgaaggccgcggcgaacatccacacgagcggcagcgcgaagacgagcgtcacgacggtgatcgtgtccccgtgcagccatgacccgtacggccgtccacgccgagggcgtgcgggggagagggtggccctcatgccggaacgggctccacgcgccgccggcgccttcgccggtactccgcgtgtgttctgcgtgctccgtccccttctccacgtgcttgcacggttcttgccctatggcatcgcctccggcggtgccgcgatactgcgacgagccgttgacccgaaaggacccacgtgacgcaccgactctccgcgaccacccggctcggcctcggcggcttggcgttcctgctcgccctcgcgggccccacgctgcccgccgccgcgtccccggcggacaccgcccgcacctccacggtgacgaccgtcgaggagcagcgcctcgatcgggccgctccgcgggagatcctgcggcgcagcggattcgacgccctcggcccgcgcttcgagcgcgctctgcgcggctccaacgggtacgcgcaggccgagcgaacagtgacccgccacgccgcggcgctgtggcggcgcgccgtcgaccgcgccc

SEQ ID NO: 4000 - DNA, 2630 bp, Unknown
  Kingdom: Bacteria, Phylum: Actinobacteria, Class: Actinobacteria, Order: Streptomycetales, Family: Streptomycetaceae, Genus: Streptomyces
agcgcggtgagcgcgggcaccaggagcatcgccatcacgaacgccgtgagcaggatgccgaacgccacggcgaagcccatctgctggagcatggcgttctcggccagcagcagcacgccgaacgtcccggccaggatcaccgccgcggccgtgatcgtggacgcggtgctgacgacggcccgtgcggtggcctcggcagggctgctgccgcgccggacctcctcacgcagccgggcgatcatcaggatgttgtagtcggtgccgatcgcgacgacgaacagatagaggatcacgggcagggtgaagagcaggccgctctcgccccggacgtcctggaagagccagacggtggacccgagcgtcgccccgaagccgaggccgacggcgagcatcagataccagggggccaccacactgcgcagcagcagacccaggatgatcatgatggcgagtccggctgccgggaagaccagcgtgtagtcgcggttcaccgcgtgctgcacatcggcgagcaccgcgctggtgccgccgaccagtacctcggtcccctcgggcgccttgctgtgggcgaggtcgcgcagcgggccggagaccaggtcgatggccgcgtccccggtcggcctgtggtcgatcagcaccgagatctgcgcgacgtccccgtccggcgcgagaaccgcgggcggcgcgctgccgaccccgtcgagcccggccagttccttgccgtacgcctccagcgcggcgggggccagcttggtgccgtcctcggagcgcaccatgacccacaccgggtcggtctggccggacgggaagctctgctggaggtcctccatcgcctgcaccgactccagctccttgggcagcgaactcccggtgtcgaagacggggttgaagctgaaggctcccacggcgagcactgcgagcagcccgccggagaccccggccaccagcccgggcctgcggccggtcagcgcgccgacccgctgcgagatccggtgctccggctgcttgcgccaggccttcgacggccagaacgccttcgcgccgagcagcgagaacaccgccggcaccagcgtcagcgcggcgaccagggtgaccgcgacggcgatggcgagcgccgggcccatggcccggaacatgccgagggtggagagcagcagagccaggaacgcgacgatcaccgcgcccgcggccgaggcgatcgtctcaccgaccttgccgaccgcgtcggccatggcctgcttgggctcctggcccgcccgcaggtgctcccggtagcggaagagcaggaacagcagatagtcggtgcccacgccgaacagcaccacgatcaggatggacgagatcgacgcgtcggtcttcagcccgccgaggtccgagacggtggcgatcagcccgttggccaccatgaagaccagagagatgatcagcagcgggaggagcgcgatgagcggactccggaagatcgcgagcagcagcaccacgatcagcaccatcgtcgccatcatgatcatggcgtcggtgttgctggaggagttcatcgtgtccacgccggtcgccgtctgaccggtgatgcccatcgtgaggtcggtggacttcagcaacggcacggcccgctcacgcagttcctcgaccgaggccatcagatccgcgtcgtaggggtccttcgtggtggccatgatcgaggccagttggagctttccgtcgcgggataccgacatctcgtcggtggagatctgtttgatcttctccagcccggcgtcgtgcagcccggtgacgaccttcttgaggtcctcccggtcgccgggtgtcagagcggccttgtcctcgcgctggaagacggcgatggacgccggctgctcctgttgcgggaaggcgcgcttctgtacctcgccgacctgcaccgactcgtagtgcgacggcaggaagtccgcctggtcgccggtcggtttcagttggggggcgagggacatcagggcgaccgccgcgatgatccaggcgacgatcgtcagccatggatgtcggacggcggactgcccgatccttccgaacatgggactcctccagagcggtctttccaagggccattgattctcgccagggaccgtttcccgtcccgtgcttccgccgggatgtggcagcaacctgccgtgcgcacccaccgcgccgtcaggtcctccgtacccgtgaccggctggcaggaagaggtcagcgatattgcctggccgggggaggcccctgattctcgaaccgctgccgccgtcggcggacgcgacggctgcgtacgggccatggccccgccgggaagaggacgaggacatgttggtcacggcatcgcccggaagtgaactcctggaccgtatcgccgcacgggacccgctgttccgggaccggacggcgcagcgcatgcaggccgtcgagaagcggctggtggacgtcgcggcggactcgcccgatccccgggtgggcgagctgacgggccatctcgccgcggcgggcggcaagcggatgcgtccgctgctggtgctgctgggggcggagttcggggaggagtggtgcgacggggtcgtcgacgccgccgtgatcgccgagctcgtccacatctcctcgctctaccacgacgacgtgatgga

SEQ ID NO: 4001 - DNA, 848 bp, Unknown
  Kingdom: Bacteria, Phylum: Actinobacteria, Class: Actinobacteria, Order: Streptomycetales, Family: Streptomycetaceae, Genus: Streptomyces
cgctgcgtcctccgctccggttcctgtcccggagcggaggacgcagcggtcgacgcggtgccggatccgtggaactcgccgtagttggctccgctgatcttcacggtcattcggggctcgcgctccttcgctgaggttccgggtgaggcgtacggtgcccagaggctgtcgagatccagggggacaccgcgtacggcgagttcgccgagcgcggcgtgcagggcgtcggcccccgaccgggccggccggtccagcggaacggccgcgtgctcccggtctccgaggatctgtccgacgagaccggtcagggcggtgccggcgccgacctcgacgaaggtacgtactcccgccgcgtacatcgcctcgatctggtcctggaagagcaccggcgaggcgagatgactggcgatccggcggcgtacctcgtcgggggacgaggggtacggtgccgcgtccgtgttgccgtagacgtcgatccggggctccgtcagcggcaccgtgcgcagatacgccgcgagcggctcgacggccggggcgaccacgggactgtggaaggcagtggacgtggccagccggcgggtgccgaccccctcggcggagaacgccttctcggcgcgtacgaccgcctccggcgaacccgagagcaccacttggcgcggagcgttgtggttggccggccagatgtcttcgaacccgccgtcggccagcaccttcgccacgtgttcgcggtccgccgtcaccgccagcatcgcgcccgggacagccgcggcgtcccgcatcagctcgccgcggcgacgtgccaggtccaccagcgcctccgcgtccagcgcgcccgcacagtgcctgtc

SEQ ID NO: 4002 - DNA, 1955 bp, Unknown
  Kingdom: Bacteria, Phylum: Actinobacteria, Class: Actinobacteria, Order: Streptomycetales, Family: Streptomycetaceae, Genus: Streptomyces
ccacgaaacagtcccccaacgaacacacccccgacgaacgcatccccacaatccccaccgcggccgcaacgggccgcgggggccgacccagcaccggcgccgggcaccggaccggccgttcacagaaggagaaacgggtggaagacaacccgtcccgcgtcgcgctcgtcagcggcggttcacggggcatcggacgggccacggtgctgcgtctggcccaggacggccacgacgtggcgttctgctaccgctcggacgagtcggcggcccgggccctggagaaggaggtgtccgaactgggtgtccgggcgcttgcggcccgcgccgacgtcacggacgccggggcggtgcgcgacctggtggcccgtacggaggacgaactcggccccgtcgacgtggtcgtcacctcggcgggcatcaccagcgacaacccgttgctgctgatgaccgacgagcagtggcactcggtgctggacaccaatctggacggcgtctaccacgtctgccgggctgccatcttctcgatgatgaagcgccggtccggtcacctcatcaacgtgtcctcggtcgccggggtccacggcaacgcccgccagaccaactactcggcctccaaggccgggatcatcggcttcaccaaggcgctggccaaggagacgggaccgtacggcatccgcgccaacgtggtcgcccccggcttcatcgacaccgacatgacggacaccctcaagggcgccgtccgggagcgggcgctgaagcagatcccgctcggccgcatgggccgggccgaggaggtcgccgggctcatcggctaccttgcctcggaccgggccggatacatcaccggatccgtcttccagatcgacggcggcatcaccctctagacgccgttccgaccaggccggatcagcaggacacacccgacgacgggaggcacagccatggcccagcgcggcccccgctggtacttcaatttccgcagcccctactcctggcttgcccaccacgacctcaccgcccggcacgcggacgtcgcggggagcatcgagtggataccgtactgggaccccgacccgcacagcgagctgctgctcgccgatgcggggggctccttcctctacaccgcgatgtcccgggagaagcacttctacgtgctgaccgacgtccgcaggctcgcggccgaccggggactgaccgtctcctggccgctcgaccgggacccggtgtgggagaccgcccacctggcctacttcctcgccgccgaccagggtgtccagaccgcctacaccgatctcgtctaccgggcccggttccgtgacggcgaggacatcaacgaccccacggtgatcgcccggatcgccggccgcctcgggctcgacccggcggcggccggaggggcggccgacgaccccgctctgcgcgaacgggccacgggcgcgctgatgtcggcctaccgggacggggtgttcggaccgccgttcctgatcgccgggcgggagaagttctggggcctggaccgcctggaccgcttcgccgacgccgtgcgctcccgcaccgcggtcccggtcgccgctccggtccccgaggccgctctgtcggcggccccgtccggagatctggggcacgccggcggctgcggctgacggcctgatcgttccaccgctcaaccatccgttcgcacgaaccgaggagagaaacccaccatgtcgacgaaccctttcgaggacaaggacgccacctacctggtgctcgtcaacgacgagggccagcactcgctgtggccggccttcgccgaggtcccgggcggctggcaggtcgtcctgaaggacgccggtcacgacgccgcgctcgcctacatcgaggagaactggaccgacatgcggcccaccagcctcgccgtggccatggactccgccacggtgtagcacggccgcacgacgacgggccgggccggg

SEQ ID NO: 4003 - DNA, 685 bp, Unknown
  Kingdom: Bacteria, Phylum: Actinobacteria, Class: Actinobacteria, Order: Streptomycetales, Family: Streptomycetaceae, Genus: Streptomyces
ccgccgctccgggagcgaggtcgagcggggtggcgcggggcgtgtaggggccctgcgggaggtggatcgtcatgtcagcggcctccggcgacgccgcgcaccggtcgtgcgggtcacagggtcagctccgggatggcgaagcggcggccctcggcggacgacttcagtcccagctcggccagttggacgccccgggcgccggccagcaggtcccaggcgtacggctcctccagggccacgtggcgcaggaacagctcccactgcgccttgaagccgttgtcgaactcctggttgtccggcacctcctgccactggtcgcggaaggactcggtgaccgggaggtccgggttccacaccggcttgggggtcgacgagcggtgctgcacccggcagttgcgcagaccggcgacggcggatccgtgggtgccgtcgacctggaactcgaccagttcgtcgcggttgacccgcaccgtccaggaggagttgatctgcgcgaccgccgacgacgccgcgtacggcatcttccaactcgcgggcggagcggtcgcgcagatcaactcctcctggacggtgcgggtcaaccgcgacgaactggtcgagttccaggtcgacggcacccacggatccgccgtcgccggtctgcgcaactgccgggtgcagcaccgctcgtcgacccccaagccgg

SEQ ID NO: 4004 - DNA, 3957 bp, Unknown
  Kingdom: Bacteria, Phylum: Actinobacteria, Class: Actinobacteria, Order: Streptomycetales, Family: Streptomycetaceae, Genus: Streptomyces
cggcggccagcgtccgcaggaacgccgctcccccgtcgatcgcggccatgtcagcccccgttccgctgcgtgatgaacgtctggagttcctggccgaaatgggtgcgcagcgcgccgatctgcgcgtcgtccagttgcgaggtccccacgggcagccccggaaggtactggtggcggatgagccgggacgccatcgggagaacggacaggcgcagcgacgtctcgttctccaggtcccgcatgagcgcggcgaacggggactcgcgacgggtctgccccgggatgtagtggtcgcgcgcctcgtccagccggtcccagtacagatcgcacttggacaccgcgacgatcagccatcgcagccgcttggccagctgcccgtcgatgatcgcgtcgaccaggagacggaagtcggccgcctccttgcggaggtgccagttccgtacggcttcctggtcgacggcgccgtcggcggcgagcgcctcgtggacatcgcgctgggagccgcgctgccagatcctgttgtgcccccagcagacgacgtggacgatgccgtgcggtgaggcgtcaccccgcatcgtgtcctggagggcccgctcgcgctgggtggaaagctgccccgggatgacggtcacggcggccctggtgcggcggttgccggagcgcaggaccgtggcgtgcttctcgatgtcggggctgcgggaactgtcgctgtcgcccgtgcggatcgactgcgtcagcgcgtcgtacaggacggtcttgcccgcccccgcctcgccggtgacggcgatggggttgaccgagaggccgagccgcccgtgcagggcggccgcggcggccccggctcccgggccgccgccgtccaccgcgtgccggacgctctcccaccgtgatcgggtgttctcccagacgtcgggcacgcgcgcagctcccccgggtaggccgatggggagatgctatcgatcaactgggcgtgacgcacgggcacttacgggattcacgggcggcccggagccgccgggccccatggttactggatgaaccggggcagccagcgcgcctggtagtcggggtggcccgcgtactcggcggccagttgccgaacggcgaagcccaggcccaccgcgcggccggagcggaagtcctcggccgggcggtcggtgtccaggtcggccacctcgacgtactcgccgagcatgacccggttcgtctcgatgcgctccagggtccgcgcggggttctggagggcgatgtgctcgtcgaacccccggccccgcactgtgaacgccaccccgccggtgcggtcgtggacctcgcccggcacatcggccgggcaccgccatcggtccccgccggcggccagtgcgacgtgttcctcgtcggcgagccgcgcccggacgaaggccaccatgtctgcgttggcgcccattggatgccgctcccttgcgctgatggatctctgcactcgatacggggagcattctggtggaccgggcgcggcccgatccacctccgcatccggttcaccccaccgtgtcccccgcgttgctcgcggtcaggtcggcgaggaccttgtgcaggggttcggtcttccggcggcggtactcctgcaccgcccagccgttgccgtccgggtcggtgaagtacatgaaggtcgccccgtcgtcgggggcgtaccgctgcggctcggagacctcgacgccccggccgaccagctcggcgtgcgcggcgtcgatgtcggtgacgcagagctggaggccgtggtacgtgcccggctgcggggtgccggtcgggtggggcagtccttcggtgagggcgatcgagcagccggatccgggcggcgtcagctggacgacgcgggcgcccggcatcacctcgtcgtcgatgtcgacgtggaagccgatcttgtcccggtagaagtcccgggcccggtcgacgtcggtcacgggcaacacgatcacttcgagggtccagtccatgggtcagctctctttcgcggggcgctcggcgcccgggtcgggccgtggttcgtcgatgccgggccgtcgctcgtccgtgccgggccgtgccccgtcggtttcggcgtcgcccgtcccctcaccggcgagcggcaccgcgccgccctggaggcgggcgaggtcggcgggcctgacctggatgacgaacagggcgaccagggcggcgaccacggcgaagcaggccgcgacgacgaaggcgctggagacgccggaggtgagcacctggtcgccccagggcggtggcagctcgccggtcctgcggaactccagcagttgggcgggcgtgccctcctggaggaatctcggcacctggtcggtggcttcgttgcggctggccgtgccgaacgtcgtgaccaggatcgacagccccagggatccgccgacctgctgggtggcgttgaggatgccggaggcggcgccggcctccttcggggcgacgcccgagacggccatcagggtcagcgacacgaactgcatgcccatgccgaagccgaacacgagcatcgggccgaggatcgagccgaggtaggagctgtggacgtcggtcagcgtcagccagccgagaccggccgcggccaggagcgcacccaccaccatgaagggtttgggtccccacctgggcagcagttgggaggccaggccggcgctgaccgcgatgacggcactcaccggcaggaaggcgaggccggcccgcagcgggctgaagtcgaggacgttctgcacgaagagggtcaggaagaagaacatcccgaacatcgccgcggcaaggctgagcatcatcacgtaggagccggagcgattgcggtcgcggaacatccacagcggtgtgatgggttgtttcgagccacgttcgaccgtgatgaacaccgcgaggagcactacggcggcggcgaacgagccgagggtcagcgcgtcggtccagccgtcctcggaggcgcggatgaagccgtagacgagcagcaccatgccgaccgtcgacgtgagcgcgccggcgatgtcgaagtggcccggacggcgttcggactcggggatgaagcgaggggtcgcgaaggcgatcagcaggccgatcggaacgttgacgaacaggacccagcgccagtcgagccactccaccagcagcccgccggcgagcagcccgatcgcactgccgcccgccgagacggccgcgaacaccccgaacgcgcggttgcgttcgggaccctcgcgaaaggtggtggtgatcagcgacagagcggtgggcgaggcgatcgcgccgccgacgccctggagcgagcgggcggccagcaactgccagccctcctgggacagtccgccgagcagcgaggcgaagacgaagaggagcacgccgaagatgaagacccggcggcggccgaggatgtcgccgaggcgtccgccgagcagcagcagaccgccgaacgtcagcgtgtaggcgttgacgacccaggagaggttctcggtggagaaccccaggtccttctgcatgtgcggaagcgcgatgttgacgatggtgacgtcgagcaccaccatcagctggcacgaggcgatgaccagcagtgccagtccgccgcggtgccgatcggaggtggccgtatcagcgggtgtcgcgtgggagcccgtcatggtggggttcgtctctcgtgccgagggcagtgcgcccggtgagggcggccggtctctgcgtcggtcggatgcacgcgggcgttcacccgaccgacgttatgccggaacccggagccccgccattcgagggaccgccgcgcgcgggcggccggattcactggagggcgtggaccgccgtgcggaagaggacgggtgcccggtgggcggcagcgacgatcagccggcccgaggacggatggccggcggcgcccagcagggccgcggtgagcaggcggtagcgtcgcgtgacccgtgcccaccgccgggggtagtcctcgggccg

SEQ ID NO: 4005 - DNA, 1174 bp, Unknown
  Kingdom: Bacteria, Phylum: Actinobacteria, Class: Actinobacteria, Order: Streptomycetales, Family: Streptomycetaceae, Genus: Streptomyces
acccggcccggatcgccgcccactcggtcttcgccgtgctcggcgtgctggtcgcgatcgccggcaccctcgtccaagcggcctgggtcccgggcgggttgatcatcgcgctggcggcctccgcgggcctcttctacggcggccggattctgacccgcacccagatcggcgcgctcgccccggcggccggctggttcatcacggtgttccttctgctgagcgggcggccggagggcgactacgtcttcggtgacgaactcggcctggtgctgttcatgctcggcgggacggccgccgctgtgatgtgcgccaccacgtccaaagtgccgcaatcagccatccgcagtggccggtccggtacgtgaagtgccaagtacgggtccggaaagacccccacaggtgtgatgcgcgggtggaggtttcacccggtcgcggagtgtccgacggcggcggccagtatggtggtgcgcgcgccgagccgtcccctggcctgcggcatgggggaagtacgggcggcggagccaatcgggagaacctgctttgagtcgtgaaactgacagttcgtcctccgggccccagggccgcggcggagccgcgtacccctcgggtacgccgccgtacggatcacgccagtatccgtcgctccatccgtcgcaggacggctctgacgagaacccggaatccgtggctccgccccggcccgaggaaccgaagaccgagacgacgctgacgacgcgcatccggatcaacatccccgggtcgcgtcccatcccgccggtcgtgatgcgtacgccgatggcggagagcgacatcgccggcggccgttccgaagcggagcgcaccggcggcaccccgcgccccggcacgccgccgcccgcacccggagccggaccttcggaccgttccgcgggcccgaacggcgcagcgcccgcggaccggccccgggacggcggccctgccgccgacccggcgcccgcggagaagccgggccgggagaagagcggcagcgactggttcgccccgcgcaggaccccggccaccgggccgggagcagccgctcagggcaccggtgcgcccggcacccccggtggcgctcccgccggctccggcggcgtcccgggccccggcacgggcggacccgctggccccggtggcgggtccgacggcgacacgg

SEQ ID NO: 4006 - DNA, 1645 bp, Unknown
  Kingdom: Bacteria, Phylum: Actinobacteria, Class: Actinobacteria, Order: Streptomycetales, Family: Streptomycetaceae, Genus: Streptomyces
cggccagggcgtcggcccgccgggcgtcgtcggtcagccggtccaccgtcgccgcgcggttcgcggccagccgcctcacgacatgggtctggtccagggcccgcagggggtcgcgcgacagcaacagccggagatacgcggagaactcggtatgcccctggtactgctcccgggccagccgcccggcgtctccgcggctgagttccagcgcggcccgcgccttcgccaggtccgcgttcaccttcttcacctgtgcggtccgctgcttcagcttctccgctgtggcgttgtaggtctcgctcgcctcctccgccgcctgatagcgggtctgcagctcgcgcagcagggcggcgacgctcctgggcgcctcgggcgcgccgagggcggtctcggcgtcgacctccgccgcgtcccgatcggccgtgtcgggggactcctccgcaccgtcctctgtgtcctccgtgtccgtggaggccgtccccgcggtctcctcggcgagcggcacggattcctcggacggtacggggcccggctcggccgacgcggcggtggcgggggagaccgtgagtgccgcggccagcgcggtcgtgcagaccacgcgcaggagcctgcctgacacgacatcacctccgtgacggagacgtagcccggctacgggctcgtccataaatgggcgaatccgatattccggtcacgtgatgtcaggtgacgcaagcaccgagcggtgtgccgcccggggtgtcccccggacggccgtggtggtggtgatgaaaggaagggccgggcctcaggccaccgggaaggcgtagaaggacctgtcccgctggacgacgacggtctccccggcggcgagcgcccggtacgacgcgctcaccgtcgcccccttcggatcggccgacccgatgtcctggaacttccacagccgctcgccgtcggccgccgagaacgccgtgacctggacggcgtcggcggcgatcagggtcttctcgctgccgctgagcgtgagcgacggggcgttgccgatgcccggcacctccgtggagcgccgccacacgagccggccgctctcccgttccaccgcgccgaccagccggctgcgctcggtggtgtggatcaggggcccggcgaccagcggggtgccgaacgccgagccgtcgctgccctcgacgcgccacagtggcttcgtcgtgtccgtctcgaaggcctggaggtccttgccgaccgccgcgtacagcgtcccgtcctcgtcgcccgcggtggccgcctcgggggaggcggcgccgtactgcttggtccacagcagcttgccggtcttctggtcgaacgagcggatggagcccttccccttggccgccttgacctcggccgccgtcaggctgaccgcgtcctgccgtacgaggacgtcggcggagcgctccacaaccactcggtaggcaggggtgcccggggcgcggcccgcgggcacgggagtccgccacagctccttgcgctgcacgatgtcgtacgcgaagaagtaggcctggacgacctccttgtccttgcccttcttcttgcccttcttcggcttcggggccttcacggtgaccgtgtgcgaaccggtgaaccagatgaccggcccggaattcccggccgcccggccgacggc

SEQ ID NO: 4007 - DNA, 1110 bp, Unknown
  Kingdom: Bacteria, Phylum: Actinobacteria, Class: Actinobacteria, Order: Streptomycetales, Family: Streptomycetaceae, Genus: Streptomyces
ccgtgcgtgaggcgctcaagaacctctgaggccgccgggagcgacgcgtccccctccgaaaaccattcgactccccgaccccgcccggacatgatcaggggcatgttccggtacgtcttcctcgcagcgcggtccgcagtcgcggacgcgccgaaggctgccgtgaacgacgcggtcgccgaggccgccgcctcggcccccgcagcagccgtcctcgcagcggcgttcaccgctgccgcagcgcccatcggcggcgcccgaagctgaccctcccccgacagtccggcggaccccgtaaggggagggtcggcggggccctggggtcttctcttctcagcttcgagttctcaaaggaacgcgccatgtccaagacggcttacgtacgcaccaagccgcacctcaacatcggcaccatgggccacgtcgaccacggcaagaccaccctcaccgccgccatcaccaaggtcctcagcgagcgcggcggcagcagtacctcctacgtgtccttcgaccggatcgaccgcgctcccgaggaggcccagcgcggcatcaccatcaacatcgcgcacgtcgagtacgagaccgacacccgccactacgcgcacgtcgacatgcccggacacgccgactacatcaagaacatggtgaccggggcggcgcagctcgacggggcgatcctcgtcgtctccgcgctcgacgggatcatgccgcagaccgccgagcacgtcctgctggcccgtcaggtgggcgtcgaccacatcgtcgtcgccctcaacaaggccgacgcgggcgaccccgagctgaccgacctggtcgagctggaggtccgcgagctgctctccgcgcacgggtacggcggcgacaccgtccccgtggtccgagtctccggactcaaggcgctggagggcgacccccgctggacggcggcgatcgaagggctgctggacgccgtcgacacgtacgtaccgattccggtgcgctacaccgacgcgccgttcctgctgtccgtcgagaacgtcctgaccatcaccggccgtggcacggtcgtcaccggcgcggtcgagcgcggcaccgtccgcgtcggcgaccgggtcgcggtgctgggcgcgg

SEQ ID NO: 4008 - DNA, 682 bp, Unknown
  Kingdom: Bacteria, Phylum: Actinobacteria, Class: Actinobacteria, Order: Streptomycetales, Family: Streptomycetaceae, Genus: Streptomyces
gcaccgatggccgcgcccccggagcgcagggcgtcgcggccgtcggtgcccagcgccagctccagggcggcggggaccgggtggcagacgccgtcggatgcggtgtagatggcgggggtggtgccgagcacccgggcctcgcgccgcccgtgggcggcgatgtccacgtagccgccgggctcggtacggtcgcgtccggcgatgggcaggggttccgcgtcgagggcgtcggggccaccggtgcgcaggagggcgaggccgagggcgggcagtgcggtgatgtcgtcgggggcgacgacgcaggtgcgtccgtcggtgccgtggaggagaagcgggcccggggaggtcacggcctgatgggcggtgacgaccgtgccgcggtcgtccgcgacgaatcccgtccctcgcggccggccggcctgatcacagattcttaccagcttcgaccggtccccactgcccatggtgcgacgttaggccgccggtgatctcctggagcgcgcggacggggaaagcgccccccacgcccccggtattcactccgagcgcccgtccaatggggtgaataggcgtgtcccccggggagcagggatggtgccggggaggggaacgtggagcgggcaccgggtggggcatgggtgcccgctccacgcatggcccgccggagcggggggccatgcgt

SEQ ID NO: 4009 - DNA, 1441 bp, Unknown
  Kingdom: Bacteria, Phylum: Actinobacteria, Class: Actinobacteria, Order: Streptomycetales, Family: Streptomycetaceae, Genus: Streptomyces
cgcgccgttgtccgggcggacgcccgcacgggcccggcacggatccggcactcgcccgagcggacgggcgggagcgggacccggcgctcgttccggggcacgccacgttgggcggcggtccgcgcgagggcgttccgcccttgcggcggcagccgcgcgtcgccgggcggatgcgctgatggagggcgcctccgggctggggagcgatgccgcacccgtcccggcatccgagccggcacccgtacccgtccgggtacgtgagccggaatccgcaccggtgcctgagccggaacctgtaccgatgcgtgagccgacacccgtacccgcacccgtgtccgagaccgcgggggaggtgcccggtggtccgccgagggtgcgccgtctcgtgtcggccgtccgggagcggcttccgttgtgggtgcgactccggtgcgggatggcgccgcgcacgccggtggtgctcgggctggtgctgctcgccgccgtgggtgtcgccgctttccacttctggtccgtacgtccccaggccgtgcgggcgccggaaccggtcgtggacgaaacggcggcgtccgcgttgccaccggatccgttacggtccggaacgcccgatccggtcccccgaccggttgcgggggagccgccggacgcgggcgggagtgggagcgggcagatcgtcgtcgatgtgagcggcaaggtgcgtcggccgggggtccgtcggctcccggcgggctcgcgggtggcggacgcgctcgctgcggcgggcggtgtgcgcgcgggcacggatgtgacggggctcaatcgggcgcggctcctgatggacggtgagcaggtcgtcgtgggcctcccgcccggcccgccggtctccggggcggccagtagcggaccggccgggatcggcgggccgggcgagcccggaccctcggcgccgctgagcctgaacacggcgaccgcggagcagcttgaaacgcttccgggggtcgggcccgtactggcccagcacgtgatcgactaccgcgcggagaacaacgggttccggtccgtcgacgagctccggcaggtcaacgggatcggcgaccgccgtttcgccgaactccagccgctcgtacggccatgagcagccgggaggcccggctcgactcccggggtgttggcaggaacatccccggaagcgcgggcgacggtgcgagcggttcggtgggtgcaccgagtgctccgggaacactgagtgctccgggagcgccgagtgattcgagtgcgccgagtggggccggctcgcgccgggaggggcccacggacctgcggctcgtgccgcccgccctggcggtctggacagccgccgcgtcgacgctgggcctgccggggagatgggtggccaccgtggccgtcgcctgtctggtgccggcggtcgttctgctggtggtggcgtcccgaacctgccggg

SEQ ID NO: 4010 - DNA, 1007 bp, Unknown
  Kingdom: Bacteria, Phylum: Actinobacteria, Class: Actinobacteria, Order: Streptomycetales, Family: Streptomycetaceae, Genus: Streptomyces
  misc_feature (839)..(842): n is a, c, g, or t
gacctgacccgcctcggccgcacgggccggacggtgatgaaggtcatgcgccgctccgagtggaccgccgtggccgtccgctacaacgtggagcagaacgagaccggcaacggctggagcggctacagcgggagcggcgacggggactgacagggaccaggggacggtgggcccggtcagcggtgcgcgaggcgttcacacgttcggggagccccatcctgatcccggcggatacgctggtcgggcccgcgagactcctccccatgggagcaatgatgagcatcgaacccgaggcctccgagccgcggtgggcggtcccgcccgagggcggctggaccgccgatgacctggacacactcccgaatctgcctccgcacacggagctgatcgacgggagcctcgttttcgtgagtccgcagacccttttccattcgcgagcggtcagcttcttcgagtggcagctgcagtcccgggtaccgcccgagctggaggtcgtgcgcgagttcaccatcgacatcgaccgctacaaccggcccgagcccgatgtgatcgtcatcgacggtgacatcatccaggacccgaaccagacccggttccccgccgagtcggtgcgcctcgccatcgaggtcgtctcgcccgagtcccggtcccgcgaccgggagaccaagcccgtgaagtacgcccgggcgacgatcccccactactggcgggtggagaaccacgacgggcgtgccgtggtgtacgtcttcgagcgcgagccggccaccggtgcgtacacctcgacggggatcttccacgaccggatgaaggtgtcggtgccgttccccgtcgacctggannnncgctgtgctgcgaggccggggcgaccgggaccttcgtacgggccggagccgccgacgggcgcgacgcgggcgcgggggccgcaggagcggcggtggccgcagcgggggctggagcttccggtgatgtcggtgtcccgcctcccggtgtctgggccaggacctcca

SEQ ID NO: 4011 - DNA, 2579 bp, Unknown
  Kingdom: Bacteria, Phylum: Actinobacteria, Class: Actinobacteria, Order: Streptomycetales, Family: Streptomycetaceae, Genus: Streptomyces
gggcggcggtcttcagcccggcccggtacttcaccgcgtcgtggcccaggtccggccgggccgccagccagtcccgcacgatcgcccgggtgcgccggttgttgaccttgccgcggcgcagctcgccgaagagccggtagacgcgcggcggcggcagcagcgccagccgggccgcgatgagccgcccttcggtacgccgctcctcggcggtcgcctcgcccgccgtctccagcagtcggcgcacgacgagggccgcgttgtggtggttgatgtccagggccagcgaagccgcgtacacccggcggtagttgacccgtacgtaggtgtgcaggaagtccagggacagctgctggtcggcggcgcccgagcggaactcgcgctgcccggtcgcggtgatcgccgcgttcacgaagagcaggacgtcctcggcggcgacgaggtcggcgacggtctcgggcgctcgtacggactcgggcgtgttcatgagattccccagggagaagcagagaggccggccggggaatggaggcgcgaacaacgaaatcatcgcttcacaggcaagtctcggaagtcgcgccggagtcccgcggccggccccggaaacgtaacggtgcagggccgctccgcgccaccgcattcgggtgcccggcgacgttccgcgcgaagagcaggccccccgtgcccggccggcggacgcgcgctcgacgcgtccggcggtgtccaggacgcgcggctccccgtgctcggccggcggacgccccggcccctgcacaaccggccggcgcacccggcacactggccccatggactcagctgccgacaccaccgcccccctgcgcatcggcctcctcggcaccggcccctgggcgcgcaacacccaggcccccgcgctcgccgcccatcccggcgtcgaactgagcggggtgtggggccgccgggccgaggcggccgacgccctcgccgccgcccacggcgcccgcgcgtacaccggcgaggaggggatcgacgcactcctggagacgagcgacgcggtggccttcgcgctgccgccggacgtccaggccccgctcgcggtccgggcggcggaggcggactgccacctcctgatggacaagccggtcgccacgacggtggagggggcccgcgcggtcgccgacgccgcggcgaaggcgggggtggcgtcggtcgtcttctgcacgctccggttcgcgcccgagacctccgcgtggatcgccgaacaggccgcggtggacggctggttcacggctcgcgcccagtggctgggttcgctctacgccgagggttcgaccagcgagtacgcggactccccctggcgacgcgagaagggcggcctgtgggacgtcggcccgcacgcgctctccgtgctgatcccggtcctgggcgacgtcgagcacctgaccgccgcccgggggccgtccgacaccacgcacctcatcatgcgccacacctccggcgcgtccagcacggtgacgctcgggctgagcgccccgcccggcgctgcgggcgtcgagatcgagttccggggggagcggggcacggcgtcgatccccggctgggacggcgcggagaccgcgttccggggtgcggtggacgccctggccgaagccgtacgcaccggggtgccgcacgcctgcgacgcgcgcttcggcctccacctcacggagttgctggtggcggcggagacgcaggcgcaggcggactgagcggcacgacggccaacgaccccagggcctccggtccggcgggccccgcggctccccgccggctcatcccggcggcagggcccggcacagggcctccaacgccgccgggtaggcggattcggcgggtgtcgcgtacccgacgacgaggccctcccgggagccctccgcgggcaccgcacccgggtgcaggtagtcggcgaggccttccaccgccaacccctgccaggccgcggcccggaccgccgaatgctcggtgccgggcggcagttccagcaccgcgtgcaggccggccgcgatcccgttgacccggacgtgcggggcccgccgctccagggccgccaccaactggtcccggcggcggcggtggcgctgccgcatgcggcggacctgccggtcgtacgcgcccgactcgacgaagtccgcgagcgtcagctgctcggtggcgctggagaactgctcgcgctcgcccttcgccgtgacgacgggtcccacgagccgctggggcagcaccatccacccgatccgcagggtgggggagagactcttgctcaccgaccccaccagcaccacatgctcgggatcgagcccttgaacggcaccgacgggctgccggtcgtagcggaactccccgtcgtagtcgtcctcgacgacgagcccgccggtggcccgggcccagtcgacgacggccgcccggcgcccggggtgcagcggcccgccggtggggaactggtgggcgggcgtgaggagtacggcgcggtcgcggcgggtgagcccgtcgacccgggcgccgtccgcgtccacgccgagcggccgggtgccgaccccgtgggaggcgagcagcgcgcggtggaaggg

SEQ ID NO: 4012 - DNA, 2116 bp, Unknown
  Kingdom: Bacteria, Phylum: Actinobacteria, Class: Actinobacteria, Order: Streptomycetales, Family: Streptomycetaceae, Genus: Streptomyces
gggcgggagtgtccggtacggggcggtcggtacggggcgttgggggcgtccggtacggaggtgtccggcggcctcggttgtggtgacgtcgaccgtggcggtgctcagccgtggcggccggcgaaccaggcgtcggcggccgccgtgtgcagcgggaaggccagcgggcgcgggctgtacaggatgtcgtagccggatgtctcgtcggtggggaccgagggcgggaggctcgcgagggggcgtgccgggagaaggccgaagaccaggaggtggccggcggtgtcgctgagggtgtcggcgaggctgacgtcctcagcggccgcctcgatgccggtctcctcacggagctcccggacgaccgccgcacgccagtcctcggcgtggtcgatgaacccgccgggcagggccgtgccgcccttctgcggctcgatggtgcgggtgatgacgacgagtccggtggagtgcgggccgatgacggggagcagggccaccgcgacgggaagcgggttgcggtaggcggtggttccgcagtgcgcgcaggtgcggggccaggtaccggcggacgggagcgcggtgtacggggctccgcaggtgccgcagtgggagtcccgtacgtaccggagcggctgcggggcggtcggggacgggctgttgccgggttcggacacgggcggactgtatcggaccgccctttccgccttccggcacttcctggtttccggcacttcctgctttcccggaggccgcgaagctgatagacggtgtgcccatgacaggaatgcgtaccgctctgcgtgctctggccgccacggccgccgccctcctcgccgtcaccgcgctctcccccgcggcacaggcgcgccccgaaccggaagctcccgacgagttcgtggcgctgcgctcggcggacccgacgatcatccaggagatgcgttacaccacggcccacacctttctgggcgagcgggtggacggataccggcagccggtctgcatcctgacccggcccgccgcccgtgcgctgcacctggcgcagaagcggctgttgcgtcaggggtactcgctgaaggtgtacgactgctaccggccgcagcgggcggtggaccacttcgtgcggtgggcgaaagacctcgacgaccagtccatgaaaggggagttctatccgcgggtcgacaaggaccggctgttcgaggacggctacatcgcggagaagtctgggcacagccggggcagcaccgtggacctgaccctggtccggctccccgctctgccgaccaggccgtaccgtccgggtgagcggctggctccatgcttcgcgccgaagggtgagcggttccccgacaactcggtggacatgggcacgggttacgactgcttcgacacgctgtcgcacacggacgatccccggatccaggggcctcagcgcgccaaccggcagttcctgaagcggacgttggccgaggtggggttcgtgaatctgccggaggagtggtggcacttcacgttcaggcccgagccgttcccggacacctacttcgacttcccggtgcaccgtcggccggtggccgggcactgacgggcgggccaccccgaggggcggggaacgggcgaccgggaccacccccgtgggctccggccgcccgttcttcatctcggacgcgaaagaggcgtgttcggttgccgaacgggcgactacggtgcccgtatgtcacagcagacgttcgatacgtacgaggaattctggccgtactacgtcgcgatgcactcccgtgccgccacccgctgggtccatctgaccggcaccctgaccgggctcgcgatctccgcgttcgggctcgcgcggggccggaaacgctatctggcggccctgccgctgatcgggtacggcacggcgtggcccgcgcacttcctgatcgagaggaacaacccggccacgttcgggcatccggtgtggtcgctgcgcggggacgcgcagatgatccggacgatgctcgcgggccgggacgcggagctggcggagaccgcggcgaagtggctggctgagcactccgggggcgagcgcgacgagggtgagcccggcggggccgggcgcggctgaggccgcacggtcggggcc

SEQ ID NO: 4013 - DNA, 2022 bp, Unknown
  Kingdom: Bacteria, Phylum: Actinobacteria, Class: Actinobacteria, Order: Streptomycetales, Family: Streptomycetaceae, Genus: Streptomyces
acgagtcccagtggcgcgggcacgggacagagcaccgcggcaccggcgggcgcgcttccggacggcttcgagccgtggcgcgggaccgtgccgggcggtcgcgaggacatccccgacgaactgcgttgcgtcgcacggggtgaagcgctgttctgcgggggtggcggcgtcgtcgcgacccgtatcagagcccacgacgggtcccgggtgtggacggcgaagagcccgggcgtccccgtccagggcatgcacctggtgggtgccactgacgacacggtgctcggctaccgcttcgccgcccaggacgtccccgagggtcctcgcagcgaggtggtggccctcgacgccgacagcggccgggagctgtggtccgtaccgtccggcgcccagtcgacggccgtcacgggccggaccatggacgccgtcgtggtcggctccgccgtggtgacggtcgacgcctccaactcccgcttcgaggcccgggacgcccacagcggtggggtgctctggacgacgccgttcccggccggcacgcagtgcgcccccgtcccgctgcgaccgcggctcctcgcgatgtgcgcggccgacgcggaggtggacgacctgcaggtgcgccgtcccaccctgcgcaccctcgccctcgcctccgggacgctgggcaggcccgtcgcggtcgacggcccggtcgtgccggtgggtgccgcccgtggcaggctcgtcctcctctcgaagcgctacgagggaacggcgccggccgggtacgacggagtggcgcggttcgacccggcctcgcggaaggtcacctatgcacggttcgacaaggtgtacgagggcacgtccggcatggcggacggcacggtctacgtgagcgggcaggccggtctcgtcacggcgctcgactccgcgaccgggcgtaggaagtggtcgcgtcagacgggagtggagggtgcttcgggccctgtggcgggagccggcgcgctgtacttcagctcggccaccggccgggtcgtcgcgctgtcgccgaagggcggcaagccgctgtggacgacggatccccgggtcgacgccctgacgggcgagcaggacgcgagcccccgcgtgaccgtcgcgggccgcgcggtgttcgtggccgcggcgacgaacaccctcttcgccttcgacgcgcagaggccgccgaggtcgggctgaccccggcggcctgccgccccccgggtggggctcagggccggcgcaagactgtggcctccgtgccccagccgagcgcgatcgtccggtcgacactccagcccgaccgctccgcgagggtggcgatcgcggcggagtcgcgcagggggctgccggtagcggtgtacgcgtgcagggccgcctcggccgcgtgcgggctcaggccgtcgggtcgggaggcctcgacgaggaccgccgtcccggtccatgcggccagccgcctgaggagctgggcggcctcctcgtcggtgcggtgggcgagggccttcgcggcgacggcgacatcggcggagccggccgtccagtcgatgcggtccggcgccgtgacgtgtccgcgcaggacctcggccggggtggcttcctccgcgatccgcagccggggccgccgcccggcgtcgtcgagagcggcgaccaccgaggcgctgcccggcccggtcaggaggcaggtgccgacgttctcccagagggggtcggctgtcagaccgcccagcaggaagaccaactgctcgcattcctcgaccagttcgccgtagcggtccgcgtcgtgggtcaccgtgtcgtgcagggtggcgcccgaggcgagccgccagggggacgtgccgtcccggagcgcgggagccaggtgcgcgagggcgagcagcagttcggcctcgtggccggtgtactcctcgcgctcgtggtcgtcgaggagctcctcgcccgtcgggcccaggcgcagcccggccccgtcgtcggagccgacgaccacgtcgtacgcggcgagcagcggaagcagtacgccgatccccggcccgggca

SEQ ID NO: 4014 - DNA, 1048 bp, Unknown
  Kingdom: Bacteria, Phylum: Actinobacteria, Class: Actinobacteria, Order: Streptomycetales, Family: Streptomycetaceae, Genus: Streptomyces
gtgctcgacccccgtgaacgggcggccctgccccgcgacatggcccggcaactgggccaccggccgctgcgcaccgtcctgcccacccgcctgctcgacggttacggccgcgagcgcacccccaccgacatcgacgccgtcgtcatcgagaacgcccggctgcgcgtcaccgtgctgccgggactcggcggccggatccactccctgcaccacaaacccaccggccgcgaactgctccaccgcaacccggtcctccagcctgccgccttcgccctcaacggggcctggttctcgggcgggatcgagtggaacatcggcgccaccggccacacggccctgtcctgcgcaccgctccacgccgcgctcgtgcccgcccccgacggctccacgatggtccggctctgggaatgggagcggctgcgcgacctgcccttccaggtggacctctggctccccgacgactccgacttcctgcacgtcggcgtacggatacgcaacccgcacgaacagcccgcaccggtctactggtggtccaacatcgccgtcccggagacccccgacacccgcgtcctggtcccggccgacgaggcctggcacttcggctacgaccacaccctcacccgggtcggcgtcccggagtcgggcggcctcgaccacacctatccgctgcgctccgagtaccccgccgaccacttctacgagctgcccgacgacgcccggcgctggatcgccgcgctcgacgaggacggccacggactcgcccagacctccaccgacctgccgcgcggtcgcaaactgttccgctggggccacgggaagggcggccgccgctggcaggagtggctgaacggacccgggggcggcggctacgcggagatccaggccggtctcgcacgcacccagctggagcacgtcccgctggaggcgggcgccgctttcagctggctggagtcctacggtccgctgtccgccgacccggccgtcgtgcacggcggggactgggccgccgccgccgaggaggccgccgcgcggctggaggaggccctcc

SEQ ID NO: 4015 - DNA, 2095 bp, Unknown
  Kingdom: Bacteria, Phylum: Actinobacteria, Class: Actinobacteria, Order: Streptomycetales, Family: Streptomycetaceae, Genus: Streptomyces
tggaccggctggcggccggggacgaacgggtcgcggcggcctcgcggcagccgttcggctcggtgaagggcgagtacgcgggggcgctcgacgtctatcgcgcgctcggcgaggaccaccccggctcccgggcggcgaagctcgtcccggaccgcctgaagacgtactacgacgccgtctccaccccgtacgccgagaagcggcactgtgaagccgtcgcgccgttgacctatctgcggacgcttccggactcggtggacgggaagctgctgggcgcgctcgccgcatggcccgacgaaccgctcgccacctcgttgtacgggtgcggtgtgtcgcgtctgggcgggccgggcggcggcggcacggagctgggagagctgctgcgtacgttccccgactccgcctccgcgcagcaggtggggcccgcgatcgggaagcggatcaaggaccaggtcgcggcgttgaagggggccgagccgtgtgcggccaccgaggtgctgcgggacctcggcgccaccgcgtccggactccccgccgagggtgtgaaggcgctgcgcgccgatgccgaccagggtgtcgtggacggggtgtacgcctgcggggtcgatcagttcgaggacgggaagttcggcgacgcgcgcacgacgctgaccgatttcgcgcggacgtacaagagcgacgggcgggtgcggaaggcgcggaacatcgccatagccgcggagatagccgacgaccggccggcggcgggcaagcggctgccgccgtcgaagcggcccggcgggtcccggatggagctggtcatcagcaatgacgcgccgaacgcggtcgaggtgctctacaccgggccggtcaccgggaccgtcaccctgaaggcctgcggcggctgcgagcgctacagcgcctccgccggagcgcggcaggcctgcaaggcgagcggcaggagctaccccaaggcacggcttcggcttcccgccggcgagtaccacttcctctacaagcacggcacgggcgcgaacgccggggtggacagctactcctcggggacgaaggtccagccgggctacacctacaccagttgcacctacgtcatcgagcggaatcccttcgggctggacctgcctctgatcccggacccggtgaagccggtgctcagcccttggggcgcgggttcttctcgatgacccggccgtccagcccggcggtgaggaaggcgccgccgtgcgagtcggagacgtagacgcgcagcaccgggcggtcctcgtggaagggcgacgaggggtccacgatcacgtaacggctctccggttcgtcgacgttgagcgtcttctccgccgtcttcagcaggccgggcagcgcgtcccagtcgacggagttcaggtcgatcgtcgtggacccggagggcagggtgccgcccatgtcgtcgttcttcgcccggccgtcgcggtagctgaagcggtcgtacagcgcggcgttggacttcagcggcgcgtcggcggaggcgtggtcgccgtagagggtgaagtcggtgaccttcgtcccgcccatgaccggcttcatcgtcttgatcgccgcccgaaccccggccggggtcagcaggtcctcggcctccggtacctcctcctcggaaccgccggtgtcaccggtcccgccggagtcgtcggccaccgggtccggcgccggagcggagacctgcggggcgctcgcccggtcgcgcgggcggtcgtcgttgtcggagctcctggacgagaacgggtcggtcgtccagaggatggcgcccgcgatcaccacggccgagacgacggacgacgcggcgctgatgcgccagacccggcgctcgacgcggcggccgcgctcgtgcggagcgtcgtacgggtcggcggcgggctgctggtacgggttgccgccggaggcggacatgggggtggaagcgggcggcggcgggaagccgtagcccgtcgggatgcggtcctcggggcctgcggacgaggaggacggggcggaggacccaccgggccgggcggacgccggaggcttccggtcggacacgggtgacgggggcggcacggacccggacgcgggtcccggccggggcggc

SEQ ID NO: 4016 - DNA, 2393 bp, Unknown
  Kingdom: Bacteria, Phylum: Actinobacteria, Class: Actinobacteria, Order: Streptomycetales, Family: Streptomycetaceae, Genus: Streptomyces
cccgcagggtcaccaggtcgtccgccaggagcctgagccgggcgtcgcgcaggtcggcctggatgacggcggcccggcgggcgacggcggcctgccggccgagcggcttgagctgccggcgcagttcgtcggtgaggtcctggacccgggccaggttggcgcccatcgcgtccagcttccgcagcgccttctccttgcgcttgcggtgcttgaggacgcccgcggcctcctcgatgaaggcccggcggcccatcgggtcggcgtgcagcacggagtccaactggccctgcccgacgatgacgtgcatctcgcggccgataccggagtcggagaggagttcctggatgtcgagcagccggcaggtgtcgccattgatctggtattcgctgccgccattgcggaacatgatccgagtgatcgtcacttcggcgtactcgatgggcaatgcgccgtcggaattgtcgatggtcagcgacacttcggcgcggccgagcgggggccgcccggtcgtcccggcgaagatcacgtcttccatcttgccgccgcgcagggatttggctccctgttcccccatgacccaggagagtgcgtccaccacattggattttccggacccattgggaccgacgacacaggtgatccccggttcgaaccgcagggtggtggcggacgcgaacgatttgaaaccacgcagggtcagggccttgaggtgcacgccgccggactctacctttcgctctcggtttcgctgatgaaggtgcagggcacatcagacggtaagcgaaggccggtacgtccggggtgggggcgggcaaagaaaaagggacgccgaagcgtccctgtgaatcttgctggtgtctctgtgaatccagctgtggtcctgcgcggcgcatcgcagaacgaccggacagcgacgtccccggcgatgcggggaccccggtgttcgggggacggcgatccgtgacgcagaacgaatcagtgatgttccgaggctaccgagcgtgctcggcccgaccggcccgagagggccagggtggtcaggtcagcgcaggctcgccctggggtacgtcgatgtcgatgctgtcgagcagcgactcttggtgctgggcggcggcgttgagcgcgtcgttctcgtcctggatccggttgagctcggattccaggtcctggacgcgctgctggagccgtcgcatctcggcgaggagtcgcgggtcggaaccgccgacgtaaccgagaagcgcctttgccatgatggatggtcctccacaatgagtgaccgaccgatgcggtgtgggtcgtcaggggatcgcacccgcgatgctcggcagggctctgtcaccactgcggttctgctgctaatcagctctaccgaacagctaaggtgcgcggggttttcagcgtctcaccaaaaagtttgacggtcaacacgatcacaccctgtgtactcgggcgtcccgggggcgcgctgccggacgatcatgcggcgcgactctcctgcgggacccgaggggtgtgcagatcttcgtcaatcccgcagccttgcacgacatcccacatctggcaaccatcggtcgccgccgggtcccgccgcaggtcatttcgggtgcggggcccgagcgggcgttccggtgaccgttcggcgcgcggcgttcaccgagcggatccgacggcccgcgcgggacgggctcagcggatggcgaatccgtcgtatccaccgcgcggggtgtcccagatctcagtgactccgtccacgcgcccgggtgtgtcgtcggaccggagccagtccagcaggcggtggcaattctcacgcggcccttctgccacgatctgcaccctgccgtcgtcgagattgagggcgaacccggtgagaccgccgatctccaaagcatttgccctggtgaaccagcggaagcctacttgctgtactcggccgcgtacccagacgacgaggcgcgcttcttcgttcatgcccgaacgctaaccggcccattgctcgtgaagcacctcgccccctttcgcccatcggctacagtcccgtcggaacagcctcactcgatcgggtgagtatcggacgggagtcagaggtcgaccgaaaagtcgatcaagtggattcgctccgcgtgccaccgaattcgatcaacgggccagtcgagcgacgtcgcaacggcgtccggagtaccaggaaggcacagcgcatgggacgccaccgacgatccgccgcaggccccgccgctgaagaacccgcggccggggccgcttcccgacgccggggcacgcgccggaagaagtccgccgtgccgatccgcaccgggctcctcggcgtctcggcggccgtggccgtcggtgcggtcgccgtcgcctcgggtctgcttcccggcggcgacacctacacc

SEQ ID NO: 4017 - DNA, 576 bp, Unknown
  Kingdom: Bacteria, Phylum: Actinobacteria, Class: Actinobacteria, Order: Streptomycetales, Family: Streptomycetaceae, Genus: Streptomyces
ggccgacaccgtcccgaccgccgcagacggcccggcggactggacggcccggcccgccggcggaggcaccgaccgggacgccaggccgtacgtctatctggagggcacccccggcacggccctccaggaccgtctcgcggtgaccaactccggccgcgccccgctgaccgtacggctacggggcgacggccgggccggggcctggatcgggttcgccgcggacaccgtcaccgtcccggcccggacccgcgccgaggtgccgctcgccctcacggtgccgtccgacacggtgcccggagacgcttccggtgaggtcgtggccgacgacggggacgaggagatccgcgtaccggtccgggtccggatcggcggtccgacgctggcggcgctcaccgtcgaggacgtcgagatatccggcggcaccatccggtacgccctggtcaaccggggcaacgcgatgctggagccccggctcgcggtacaggccgaggggatgttcggcgcgctgctggaccgcccggaacggcccctgccgctggagctggcacccggccggcgggtggagcggaccgaacc

SEQ ID NO: 4018 - DNA, 1000 bp, Unknown
  Kingdom: Bacteria, Phylum: Actinobacteria, Class: Actinobacteria, Order: Streptomycetales, Family: Streptomycetaceae, Genus: Streptomyces
tcgcgggcgacgacgtggacctgctcaccgacccggccgcgcgggcggccctgcgccgctgtcagggcgaggcctgccaccgcctctacctggacacctcgcgcggcgggcggcggcgctggtgctccggcgaggtctgcggcaaccgcgaacgggtcgcccggcaccggcgcaggaccctggggacggccgacgtgcgcggcccggagaaagaaattccgcccggcgttgagtgaaccggtccccgcccccgtatcgatggtcgaagagctcgttccagaggtctcgaccgggaggttcgggtgcgcaaggatgcggccgtggccgatgaccgtccgcacagggctcgacatcgcggtgagccgtccccgtccccctccgggatccccgacgaggaactgatgcgggcgctgtaccgcgaacacgccgggccgctgctcgcgtacgtgctccgactcgtcgcgggcgaccgccagcgggccgaggacgtggtgcaggaaacgctcatccgtgcctggaagaacgccggccggctcaaccgggccaccggctccgtccgaccctggctggtgacggtcgcccggcgcatcgtcatcgacaaccaccgcagccggcaggcccggccgcgcgaggtcgatccgtcgccgctggaggtcattcccgcggaggacgagatcgacaaggcgctgtggctgatgacgctctcggacgcgctcgaagatttgacccccgcgcaccgggaagcattggtcgagacctacttcaagggacgtacggtcaatgaggccgccgcagtgctcggagtccccagcgggaccgtgcggtcccgggtgttctacgcactccgttcgatgaagctcgcactcgaagagagggggatcacggcatgagcgaccagcagtggcagccgttcgggccccggccccccggccgccgcacgccgtccggtccctcgcgtttcccgtataccgcgggtcctgcacacccctcagggcccgcg

SEQ ID NO: 4019 - DNA, 684 bp, Unknown
  Kingdom: Bacteria, Phylum: Actinobacteria, Class: Actinobacteria, Order: Streptomycetales, Family: Streptomycetaceae, Genus: Streptomyces
ggccgcgcccgccgaggccaagccggccccggtgaaggccgccgccccggtgaagtccgccgaggccaaggccgcgcccgccaagaagacgccggcgccgcgcaagcccgcggccaggaagaccccgccgcccgccggcaagtgacccgcacgggtcctcccggtacgcgggaaggggtacgcgtgaccgggacgcggggcgggcacctttacgggtggccggctcgttgtcccggtaccttgccccttccggccgcagggcgatcatccactcactaggcggtacacaccatgttgctctcagcgttcggctcggtcctccagctgctctatctggcgatgctggtgctggccgtggtcgcgttcgtcttcgcggcgaccgcccgtgaggacgcctaccgtgccgccgacaagaagaagaagtccttctggctggtgatcctcggcgtcgccgtcgccgtgaacctgctcatcccgatgctgttcctgcagctcgcgggcgtggtcgcgtcgatcgtgttcatggtcgacgtgcgacccgcgctcaaggcggtctcgggcggcggtggccgcagcggcggctccagcagcgacggcccgtacggtccctacaacggcgggcgctgagtccccgccgccctcgcgggcggggacggcggccggtcgacggacgcggggtgggag

SEQ ID NO: 4020 - DNA, 4312 bp, Unknown
  Kingdom: Bacteria, Phylum: Actinobacteria, Class: Actinobacteria, Order: Streptomycetales, Family: Streptomycetaceae, Genus: Streptomyces
gcctggcgctggctggaggagaccgagctgctcgcggcggacctggacgcgatcggccccgctccgtgggacgccgcggccgacccggcggacgaccgggaggtccgtgtctggacgcccgcctggcagttggggctgccgctgggacatctggccgtccatctgtgctgagcctctcgctcaggaaccgtgcaccccggcacggtacttgggcagccggagcgtgatcttcatccctgccccgacgccggtctcgatgaccaggccgtagtcgtcgccgtagacctggcgcagccgctcgtccacgttgagcaggccgatgccggtggaggcgccgccttcgccgcgcaggatctgccgcagccgttcggggtccatgccggttccgtcgtcctcgatgaccacctcggcctccgatcccgcgtccagggcgctgatggtgatgcggctgcgggtgaccgctccttcgaggccgtgcttgacggcgttctccaccagcggctggaggcacaggaacggcagcgcgaccggcagcacctcgggggcgacctggagggtcacggcgaggcgttcgccgaagcgggcgcggacgagcgccaaatactggtcgatggagtgcagttcgtccgccagggtggtgaactccccgtgcctgcggaacgagtagcgggtgaagtcggcgaactccaggagcagttcgcgggcctgttcggggtcggtccggacgaacgaggctatggcggcgagcgagttgaagatgaagtgcggggagatctgcgcccgcagagccttgatctcggcctcgatgagctgggtgcgggagcggtcgagctcggccagttccaactggacgcagacccagcgcgccacctcccccgcggcccgggccagcaccgccgattcgcgcggggcgtaggcgacgagcgcgcccaggacccggttctcgacggtgagcgggacggcgacggcccagcgcagcgggcagtcgaggtcggcgcagccgctgtcgaaggcggtgcggcggccgttgtccagcagcgccctcaggtgctccatgacgtccttgccgtggtggtgcccggcgccgtcccagaccagcacccggtcccggtcggtgaggcagagggcgtcggtgccgagcagggagcgcagccggcgggcggcgcgccgggcactctcctcggtgaggccggcccgcagcggcggggcggccagcgaagcggtgtgcagggtctcgaacgtggcgtgctccacgggcgtgccgacgtcgctgggccgcagcgggcgggccgtgcggcgtcccagcaggtacccggcgccgagcagcagcatggccaggacgacgagaacggcgatcgctgctccggtcatcgttcccgccctgctgcggaccgagtcgaggagagtgcctcggggaggtggaagcgggtcatggcggcgttggtgcccgggggtatccgccccggtgtggcgagcgagacgaggatcatcgcgaggaaccccacagggacggaccagacggcgggccaggcgagcagggcgtgcggccagcccggcgggcgtaccgctccgctgacggtgatggccaccgcgacgagagcggaaccgccgcccagcaggagccccgcgacggccccgggcggggtgagccgccgccaccagatgccgaggacgagcagcgggcagaaggaggaggcggagacggcgaaggccatgcccaccgcgtcggccaccggtacccggctcaccagcagggagccggcgagcggcacggcgatggcgaggacggtggcgagccggaagtggcgtaccccgcgcgagggcaggacgtcctgggtgatgactccggcgacggccatggtgaggccggaggcggtggacaggaacgcggcgaacgccccgccggcgatcaaggccccgagaaggtcgccgccgagtccgccgatgagccgggcgggcagcagcaggacggcggcgtccgcgtcccctccgtaccgcagttcgggtgtgtagagccggccgagcgcgccgtagatcggcgggagcaggtagaagaggccgaccagggcgaggacggcgacggtggtgcggcgggcgtcgcggccgttcgggctggtgtagaagcggacgacgacatggggcaggcccatggtcccgaggaaggtcgccacgatcagtccgtaggtggcgtacaggggatggtcggcgcggaagacggcgagctggtcgtcgaagctgacccggggccggccgtcgccctgccaggcgaggaccaggaagagcgcggggaccaggagggcggtgagcttcagccagtactggaagacctggacgaaggtgatggagcgcatcccgcccgcggcgacggcggcggtcacgacggtggcgacgaggacgtcgccgagccagccgggagcgcccgtgaggatcttgagggtcagtccggcaccctggagctgcggcacgaggtagagccagcccgcgccgacgacgagtgcgctgaccagtcggcggacctgccgtgattcgagccggccttcggcgaagtccggcagggtgtacgcccccgagcggcgcagcggggcggcgacgaagaccaggagcaccaggtatccggcggtgtagccgaccgggtaccagagcatgtcgggaccgtggacgagaacgagtccggcgacgccgaggaaggaggcggcggagaggtattcgccgctgatcgcggcggcgttgaggcggggccgcacggtgcgcgaggcgacgtagaagtcggaggtcgtacgggagatgcgcaggccgaatccgccgacgaggacggtggcgaggacgacgacggcgaccgccacccaggacgccatgtggtcgggggtgctcacggggcggggcggccctccaccagccgggcgaagtcgcgttcgttgcgctcggcccggcggacgtaccaccaggcggccagggtgagcggcgggtaggtggcgaagccgagcaccgcccagaccagggcggagctgttcagcgcggcgaagaggagcggcagggtgcccgcgacgagggcgaggacgccgaagacggtgagcccggcgcgcagttggccgcgcatcagcgatcgcacataggcgccgccgagggcggtctgctcgtcgatctccgactgggtgcggtagcggggcagcgggcgcacccgccgcggctcccccgtgaccacctcgcgccggggtgatggctctgcggacatgggctcggagtgtaggcgtcggcggaccgtgctgggaagagttcggagaaggactccccaggtcagcggccaccctggcgcatcagaaggtcgcgcagggcgcgggtgtggcggcggctgacggccagctcggcctccccgatgcgcacgctcatgctgcccgcgtccaggcgcagttcgtcgatccggccgagcgccacgaggtggcggcggtggatccggacgaagccgcgggagcgccagcgctcctccagggtggtgagcgggatgcggacgaggtggctgccggtggcggtgtgcaggcgggcgtagtcgccctgcgcctcggcgtacgcgatctcgtcgacggggacgaagcggatgacgccgccgagctcgaccgggatctggtcgcccgcgctgtcgtggaccggtgcggaccggtcccccacctgttcggcgacccggcggacggcttcggcgaggcgttcgcggcggaccggtttgaggacgtagtcgacggccttgaggtcgaaggcgtggacggcgaagccctcgtgggcggtgacgaagacgatgagcgggggcgcggcgaacccggcgaggagctgggcgacgtcgagtccggtgagtccggccatgtggatgtcgaggaagaccacgtcgatcgcggacggatcgtcggggctcgcgtccaccgcgccgccgatgcggcgcagtgcctcggtcgcgccggtggcgccctcggcgctgcggacacgggggtcggcgcgcaggaggtagaggagttcctccagggcgggttgttcgtcgtcgacggcgagtacgcgcagcatgaggccggagtttagggggtgtgaaggccgatggcttgagtgatgggtggcttgttcccgtaccgcagtacatgcagacgaccgaaccccatatccgggtgggggcctatgcgctgggcgcgctcgggagcgccgacgccttccggttcgaggagcatctggcggactgtcccgggtgccgtgtgcgggctcgcgagttcgccggggtgagggcaggtctggcggtggcggggccgccggcggtgccgccaccgccagacctgcc

SEQ ID NO: 4021 - DNA, 5011 bp, Unknown
  Kingdom: Bacteria, Phylum: Actinobacteria, Class: Actinobacteria, Order: Streptomycetales, Family: Streptomycetaceae, Genus: Streptomyces
cgctggctgcgcgccacgctcggcccggccaccggtctgccgctgcccgagggcgacggcaccggcacgggcgcgggcgacggctccggctcgaccgggcagggcatcgtgctggagctcgacgagtcgctcgctcccgagggctaccgcctggccgtcgaggccaacgccgtacgcatcacgggcggcaccgcggccggggtcttccggggcgcccagaccctccgtcagctcctcggcccggacgccttccggcgcgcccccctcgcccccggccgcacctgggaggtccctgcggtcgtcgtcgaggacgaaccccgtttcggctggcgcggcatgatgctcgacgtctcacggcacttcctgcccaaggacgacgtcctgcgctacctggatctgctggccgcccacaagctgaacgtcttccacttccacctcaccgacgaccagggctggcgcatcgagatcgagcgctacccgcggctgaccgaggtcggctcctggcgctcgcgcaccaaatacggccaccgggcatccgagctgtgggacgagaccccctacggcggcttctacacccaggacgacatccgcgagatcgtcgcctacgccgccgagcggcacatccgggtcgtccccgagatcgacatcccgggccactcgcaggcggccatcagcgcctaccccgagctgggcaacaccgacgtcatcgacaccaccaccctctccgtctgggacacctggggcgtcaacccgaacgtgctcgccccgaccgagaacaccctgcgcttcttcgaaggcgtcctggaggaggtgctggaactcttccccgccgcgacctcgccgttcgtccacatgggcggcgacgagtgccccaaggaccagtggaaggagtccccgctggcccaggcccggatcgccgaactcggcgtgaaggacgaggacgggctccagtcctggttcatccggcacttcgacgcctggctcaccgaacggggccgccgcctcatcggctgggacgagatcctcgaagggggcctcgccgagggtgccgcggtctcctcctggcgcggttacggcggcggcatcgccgccgccgaggccgggcacgacgtcgtcatgtgccccgagcagcaggtgtatctggaccaccgtcaggacggcggtcccgacgagccgatgcccatcgggtacgtccggagcctggaggacgtctaccgcttcgagcccgtcccgccgggcctgagcgaggaggcggcccgtcacatcctgggcacccaggccaacgtctggaccgaggtcatgcagaaccgggcccgtgtcgactaccaggtcttcccgcgcctcgccgccttcgcggaggtcgcctggtccgccctgcccgccccggccgaccgggacttcgccgccttcgacgcccggatggcggcccactacgcccggctcgacgccctcggcgtggactaccgcccgccgggcggtccgtacccccggcagcggcgacccggcatcctcggccgcccgctcgacggggtgccgccggtggtgtgacccccgcaccgccccgcccggccgcggccgtcctccgggaccgccgcggccggcgcgcgtccggggccaacagccctgccgccacgcgccggagcgaggccgcgaaccgcataagtcgtacaagcctcgctgaagagtggcaattcaccctccctgccgaagaagtgcgaaaccggaacatctcgcaggtcagggacggatccatccttcgcggaccctcgcgacggtccgatcggaagatgtgccagagttgccacgtccgggctgtgaacacgtaccgtacggcggaacaggcggacagccgggagaccgggaaggggcagctgggttgaccacgcacgcaccgcaggcgatgcagtcggtgacgctgccggcctcgttggacgaggccgtggcggcactcggcgccatgcccgcagccgttccggttgcagggggcacggacctgatggcagccgtcaacaaggggcttctgcgcccctcgggactggtcggcctcggccggatcagcgagctgcgcggctggcactaccaggacggtcacgcgctcctcggcgccgggctcacccacgcccgcatggggcgccccgacttcgccgccctgatccccgccctcgccgcctccgcccgcgccgcgggaccgccgcagatccgcaacgcgggcacgctcggcggcaacatcgtcacctccgcgcccactggcgacgccctgccggtgctggccgcgctggaggccgagctggtcatcgcgggtcccggcggagcccgccgcgagatccccgtctcgcacctgctggccggccgtgaactgctggagcccgcggagctgatcggcttcgtccgcgtaccgctgctgcacgccccgcaggtcttcctgaaggccaccggccgcaccggcccgggccgcgccaccgcctcggtcgccatcgtcctggacccggcccgccggggcgtgcgctgcgcggtcggcgccatcgccccgatgccgctgcgcccgctggaggcggagcactggatcgcctcgctgatcgactgggacggcgagcggggcctggcccccgacgcgctggccgcgttcggcgagtacgtcgccgcggcctgcatcccggaccacgcaccgccggccgacgggacagaggccccgccgctgtccccggccgttctgcacctgcggcgcaccgtcgccgcgctcgcccgacgcgcgctggggagggcactgtcgtgagcaatgaggattaccccgaccagcacgaccagcaggggaggcagggccactccgagggcccggacccccgttacggcggctgggagccgacgccgcagggcgacgggttcgacgccgacgccaccgcgttcgtccacctcccgccggaggacctggcgaacatccccctggccgcgcccggtcaggggtacgtcccgccgatgatcctgccgctgactccggccgcgggtctggacccggcggcgacgggcagctgggtgctccagacgcagacccagcaggcgcaggccgagcagcgcgcccaggaggccgccacccaggagcccggcgcggtccactggccggacccgaaccagcagggcgggcagggcggttaccagggcccctaccaggacacgtcgcacgccacggcccagtggaacttcaccgaggccttcggcgggtcggcggcggccccggaggcggctgcggcccccgaggcgcaggtcccggatgccgggcacctcggccaccccgaccaggcgagccacgccggtcataccgaccacgccggtcataccagccacgccggccataccagccacgccggccacaccggccagtggacgatcccggtggcggacggggatctcccggacgaatcgggcgagttcctggcctcggcgcacacgccgcagtggtacgcggacagcgcccgcccggcaacgcttcccggcggcgcccccgccccctgggccacgccggagccggagccggtggccgaccccgtacccgtggcggaccggaccccggaagcggaaccggcgacggacgatccggcgacgagcgaacaggcagaccaggcagaccaggtagaccaggcagcacaggcggcggacccggaacccggcaccaccactgccgacatcgagagcccccccgccgaggaagccggaacggcctccggcacggcgcccgctcccgaggccgacgcgaacacggacgcggcaccggacacagctctggacggagccccggacgcgactccggaagcggacccggacgcgactccggaggcggacccggaggcggcagccccggaacccggcccggcccccgccctcctcgacgcaccgagcgagcacccgtccgcgtcctacctgctccatgtgaacggcgtggaccgcccggtcagcgacgcctggatcggcgagtccctgctctacgtgctccgcgagcgcctcggcctggccggggccaaggacggctgctcgcagggcgagtgcggcgcctgcaacgtccaggtcgacggccggctggtcgcctcctgcctggtccccgcggccacggcggcgggcagcgaggtgcgtacggtcgagggtctcgccgtcgacggcgaaccctccgacgtccagcgcgccctgtccgcctgcggagccgtccagtgcggcttctgcatccccggcatggcgatgaccgtccacgacctgctggagggcaaccacgcccccagcgaactggagacccgccaggcactctgcggcaacctctgccgctgttccggctaccggggcgtgctcgacgcggtcgcggacgtcgtggcggcccgcgaggcgagcgccgaggcggccacggcggtccaggacgaggcccgcatcccgcaccaggccgagccgggcgccggcggcgtgcagcaggtcccccacccgcacgagggggaggcgctgtgaggcacgccagcggccccgccgtacagcagcaccacgcgaacccagggcccacctcccgccgccgcaccggcggggcgaacgacaaggaggcggcgtgagcagcgacgcggccaccgcggccaacgcgaccagcaccagcctgcccaggatcgacgccatcggcggcggaccgggcgcgggttccggcccggacgaggcacagcccctgatgggcctcggcgcgtcactgccggccgccgacgcccgtgcgaagaccgagggcaccttcccgtacgccgcggacctctgggccgagggcctgctgtgggcggccgtgctgcgctccccgcacccgcacgcgcggatcctgtccatcgacacctcgggcgccgaggagatgcccggggtgcgcgcggtcgtcacgcacgaggacgtgccgggggacagcaactacggccgccatgtggtggaccgtcctgtgttcgcctcggacctggtccgccaccacggcgagccgatcgccgcggtcgccgccgaccaccccgacacc

SEQ ID NO: 4022 - DNA, 1772 bp, Unknown
  Kingdom: Bacteria, Phylum: Actinobacteria, Class: Actinobacteria, Order: Streptomycetales, Family: Streptomycetaceae, Genus: Streptomyces
acctgaaggcgccttcaggtggcttcaggctgcgttcagcaacgtcccggcagtgtgggtcacgtcgaacagcggcagctctcgggaggaaccctcatgaagcgcaacgtcaccatcgcggcgatcaccgcggccgtactcatcggcggcaccaccgccgccaccgtcgccttcgcggacgacggtgaccgccgggacggcacgtccacgcagcagccggccggcacggaccgcgacgaccgcgacgacgaccggtcctacgccgacgcggaggccccccggacggacggcggcgtgaagagcacccggatcaccctcgaccaggccgtcgccgccgccctgaagagcgtcccgggcacggtcaccgaggccgagctggacgatgacgacgacgacaacggccgcgcggtctgggagctggacgtccgcggttccgacaagaagtggcacgacgtgacggtggacgccggcaacggcaaggtcctgaagacccgcgacgacgacaacgacgatcgcgaccgccacgcgccccgctcctccgccgtcaccctgaaccaggcggcggacgcggccctgaagaccgcgccgggcagcgtcacgtcgatcgacctggacgacgatgacgacgacgaccgtcggagcgacgtcctgcggtgggacatcgacatcgcgggcaaggacggcgagcagcacgagctgcgcgtggacgcgaagaccggcaaggtcaccgtggaccgcgacgacgacggtgacgacgaccgggacgacgaccgggacgacgaccgtgacgaccgggacggcgacgacagctgacggaagcccgggcggacacacctgaagcaggagaaggccctcggagcggcacacgccgctccgagggccttcgtcgcgtcgctcaggatccctccgtcagccccgccaccagctcatcggccgccgcgtacgggtccagcgtccccgccacgatgcgctcggccagggcgtgcaggcggcggtcgccgcgcaggtcggcgatcctctcgcggagcgcggtgacggcgatcgtctcgacctcgtgcgcggctcgggcggtgcggcgttcggccaggacgccgtgctcctccatccaggcccggtgcttctccagggcctcgacgacctcgtccgtgccctggccccgggccgcgaccgtcttcacgatcgggggacgccagtcgccggggccccgggactcccccaggcccagcatgtggttcagctcgcgggcggtggcgtccgcgccgtcccggtccgccttgttgaccacgtacacgtcgccgatctccaggatcccggccttggccgcctggatgccgtcgcccatgcccggagcgagcagcacgacggaggtgtccgcctgggaggcgatctccacctcggactggccgacgccgaccgtctcgacgaggaccacgtcgcaacccgccgcgtccagcacccggatggcctgcggcgcggaccaggcgaggccgcccaggtggccccgggtcgccatcgagcggatgtagacgcccgggtcggagacgtggtccgccatccggatccggtcgcccagcagcgccccgccggagaacggcgaggacgggtcgacggcgaggacgccgacccgcttgcccgcccggcggtaggcggtgaccagggccgaggtggaggtggacttgccgacgcccggcgagcccgtgagcccgacgacgtaggcgtggcccgccagcggcgccagcgcggccatcacctcccgcagctgcggggacgcc

SEQ ID NO: 4023 - DNA, 538 bp, Unknown
  Kingdom: Bacteria, Phylum: Actinobacteria, Class: Actinobacteria, Order: Streptomycetales, Family: Streptomycetaceae, Genus: Streptomyces
aacccgcatcacctcctcccacggtgtccggcccgccgcccggcccgcccagcggcggcgaccacggcggaccgcacggttcagggggttcggcccccgaggggcccgagagcgggccggacggcggtcctgtggggcggccggatggcggcggttgcacactcacggtctctgctccccgacgtcgggtccccgccccggacgtccctgcccggtcccgtttccgtaccggacacatcgatcgaccatccagggcatttcgcctcattgtctgtcccgtcccggcggtccccgcaagcggagggaggaaccggtttcccggggagcgggtcgttcggtccctgcttagcgtggtggcgtgaacgtccgggcgagtaacgacgagaacggcgcacgctccccccacggctggcgtgacgcgctcctgacggtcctcaccggcgtactggccatggtggtgaccgcggcgctgggcctgtgggcagccggcgccgccggcctgcccggcggcgcgttcccggccgtcgtcgccgggcag

SEQ ID NO: 4024 - DNA, 702 bp, Unknown
  Kingdom: Bacteria, Phylum: Actinobacteria, Class: Actinobacteria, Order: Streptomycetales, Family: Streptomycetaceae, Genus: Streptomyces
gtgatggcccgctgaccgcagaacaggaagaccggccgcgcctcctgaccacccgtcaggcgtgcgagcaggacgtactccgaggaaccgggttccaggcggtagcgctccgagccgatctggaacgccacccggtccgggcccgggtcctgctcgacgttgatccgtaccccgggcagcagggtccgcaggtgagcggccatccgctggttcgacatcgggccgccgacgcagaactccgtacgctccccgaacccctgctgcgcggtgtcgtgcgtgacgatctgcgcgtgcgccgaacagtccttgatcagcgcggagagttccagcagggcgaacgcgtcgtagcggtgcaccgaaccgtcggcgcccgcgtagcggttgacgaccagcaggcattcggagttcgccggcagcccgaagaagtcctgtttgcggcggagtccccgccgccagaggtaggtccgggcgagccagcccagcgaagcgctgatcccggcggctatcacgcccagcacgatgttgcgtacgtcgtccgtcatgggcgcgcatggtatcggtcattcgggtaaccgttcgaggcggtcctgacgatccggatcccccggggctaccctgcggcgggagatccgttgactggaggtacgtatgcgccgttccgtcggccggaacacgtcgctgttggccgtcctcgccgtggtc

SEQ ID NO: 4025 - DNA, 2806 bp, Unknown
  Kingdom: Bacteria, Phylum: Actinobacteria, Class: Actinobacteria, Order: Streptomycetales, Family: Streptomycetaceae, Genus: Streptomyces
cgtgtgctggtcgtgaccgcgtcccgttccaccgggacagcggtcacgaccagcacacgcacgggttcagcctcagggtcgaggacggggggaagggtgctcctcggtgagcgggtcagtccttcttgagctcgaactgccagatgcccgtgagcttcttgcccttggtctccacgatggagatgttcgtcttctcggacggcttgcccgtctggctggcgaagaaggcgctgccggggatcgtgcggtaggtcttctcgtacggctcctgctcggcctgctggccgttgatgaagagcgtccagccgttctcggcgatctcggggtcgacgccgaagcggaccttgtcgtccatggagacggtgatggacttctcggccttcttgttcaggcagccctggatcagggactccttgatcgcatcgccgtcgttgtaacagacggcctcggtgttcaccgagtcactgccgaccgtcacggtggcgagcggcgtcggcttgtcgcaggcggacaggacaaggagtcccgcggacacggcaccaagagcgacgccgattcgacggcccttaccggagaagaacgcaacggtcatgggccgaaggctatcggtcgcctccgctcatgccacgcgggggtgcggcgtgccgcgccgcgcggctcccaggaggccccgtacggacgtggccgcgccgagcgcgagaatgcccgcggcgaccgacatgccgagcaccgcgttgagcggcagggcgatgccgatgccgccgccgaccacccacgccatctggagcaacgtctcggaccgggcgaacgcggaggtgcggacctcctcgggcacgtcccgctggatcatcgcgtcgagcgacaacttggacagggcctgggtgaagccggcgaccgcgccgagcgcggcgaccagcacggtggagaagaacaccgcggccaggaccgccacgctcagcgcgagccccagcaccgtcgcgatgatcacctcggggccgcgttcccggagccaggagcccaccgccgtgccgcaggcgttgccggcccccgccgccacgccgacgatgccgagcgagaccgccgcgctctgcccggccagcgggtgatcgcgcagcaggaacgccaggaagaagatgaggaaaccggagagggcccggtgcgcggcgttggcctggagcccgtgcaggacggacccgccgacggaccgcagacccggtggccgctccttggcggctttctgcccgttgccgcccctgcggaggcccgcccgggtgctgcccttgccgggggcgggccgcggcgtggtgtcctcgtggtgcgggacgatcagccgcgcccggcgctcgcccttcgcggagtcgaccttgggcggcagggtgaaggcgaggaaggtgcccgcgacgaagatcgcgcaggcgccgtagagcggccacggcgagccgatggtctggaggccggccccgatcggggccgccaccccggtcgccagcagcccggccagggtgacccgggaattggccttcaccagggaaaacttgggtggcagcaggcgtggcacgaccgcgctgcgcaccacgccgtacgccttcgagcagaccaggacgcccagcgccgccggatacagctccagaccccccgtggcgaccgcgcccgacatggtgatcgccagcagcgcacgcgccagcatcgcgcccgccatcgcggcgcggcggccgtgcggcagccggtccaggagcggtccgatcaccggggcgaggagggtgaagggggccatggtgatggcgaggtagagggccaccctgccccgcgcctcgtccgtgggcaccgagaagaagaccgtggaggcgagcgcgaccgtgatcatgacgtcgcccgcgccgttcaccgcgtgcagttcgatcagttttccgaggccggattcccccgcgccgtgggcgtgcgtcgccctgcggataccgcgcgccgtgccggtgaacggggcgcgcagggcacggcccgtcgcccgtcccgccctgcggagcgggccgggaccgtcgtgcgacctggcggcagtcaccccgtcatagtgccccaaccccggccggtatgaacggtgatcgggtgcggacgcgcgggtgacgccctgtcggacgagcgcgcctgggccgtcctgggccctgcggccaccgccgtccgatcgtcatcggcgggaacccggcgggaacggatacggcacgtttgggacgggcaggtgggcgcggagcggcggagagggtagcgtgcgtaacgcgccaccggcggttgttcttggccgcgcgcctctcggcgatcccgcagaatgggtggcagaaggcgcgcccgaggcaggcacaacgggtgtggacgtcgacgcggcccccaggtccgctccgcccgcacttgtctggccgaaacggcaatcgtgcagcagctggcgcgctcgtgagactggcgtatggagagaagcgaagacctgtgagtgctgcgacgacgacgcgaagccgtacggcccggacccccgttcccgaccgcctgtgcgccgaggcggtggacctcgcacgtgcggccgccgaggaggccgccgcgcccggtgtggtcggtgagcacatcggcgtggtctccgagggagaccgggtcgtcacgcactacttcgaggccaaggagcccgggtaccggggctggcgctgggcggtgacggtggcgcgggcctcccgcgccaagaacgtcaccctggacgaaacggtgctgctgccgggggccgacgcgctcctggcgccggagtgggtgccgtggagcgagcggctgcgcc

SEQ ID NO: 4026 - DNA, 1725 bp, Unknown
  Kingdom: Bacteria, Phylum: Actinobacteria, Class: Actinobacteria, Order: Streptomycetales, Family: Streptomycetaceae, Genus: Streptomyces
ggccggggccccggccgtcgccgactgccccgcgacactggccggaaaggcccggtgttacaccggacaggacgagaacggggcccactacgcgctcgccgtccccgtccgctggaacggctcgctggtggtgcacgcgcacggcgggcccgacctgggcgccgcctcggacccggcccgttccaccgaggacctggagcgttgggccgtcatggtcgaggaggggtacgcctgggccggctcctcctaccggcgcggcggctacgggacccggatggcggcggccgacaccgagagcgtccgccgggtgttcctcgaccggttcgggaagccggagcggacctttgtgcacggccagtcctggggcggcaacgtggcggcgaaggtcgcggagacgtacggcacggagccgggcgcgtacgacggggtgctgctgaccaacggcgtcctggccggcggctcgcgcggctacgactaccgggtcgacctgcgggtggtccaccagtactactgcggcaaccacccgcgccccaccgagcaacggtatccgctgtggcaggggctgcgtccgggctccacgatgacgtcggacgggctgagcgcccggctgcgggagtgcacgggtttcgacgccgaaccggcggagcggaccgcgctccagcagcgcaacctcgacgacatcctggccgtcaccgggatcccggagcggtccctggagtcgcatctgcggttcgcgacgttcaccttccgcgacatcgtcgcgacgcggctgggcggccgtaaccccttctccaaccggggggtcaggtacgcgggttcgcacgacgaccgggcgctgaacgcgggtgtggaacggttctcggcggaccccgccgcgcgtcgggacctctcgtgggacagcgacctcaccgggcgggtgtccctgcccgtcctcacgctgcacgcgatcgaggaccccacggcgttcgtcgagcacgagtccgcctaccgggacacactgcggagcgcgggccgggagcaccgtctcgtgcagaccttcacccgggagagcgagcacagcgggctgagcagtgcggagtacgccaactccatcaccgcgctggaccgttgggcccgcaccggccgcaagccgaccccccgctcgctggccgcgtcgtgcgccgccttcgaccggagtcgcggcacgggctgcttctacgatccggcgttccggccgtccccgtacgcctcccgggtcctgccccggccgggcgggctcgcctggccggccatgaccgccgggcaggagcgcgcctggggccggatcgacggggtgggcatcgccccctgacgtcgcaccctcgacgtcacacccccgacgtcgctccctgacgcgccgccgtttcccgtgaggcgccgaaactcccccgtcacaccggccgttcgcgagggtaacggcggctgcctagcgtcgcccgctgtgcctgagcacggacaaggcggccgagcacgtcctgccggcctcgcctgcggtacggccctctccggccgtaccgccctcgcgcacctgaccggcgtcagcccgtcttcgcgtcccgcagcagttcctcgatccgggacagctcgtcctcggtgaactccaggttccgggcggcctcgacgctgttctccagctgggcgacgctgctcgcgccgacgacggcggaggtgagccggccgccgcgcagcacccacgccagggccagc

SEQ ID NO: 4027 - DNA, 1224 bp, Unknown
  Kingdom: Bacteria, Phylum: Actinobacteria, Class: Actinobacteria, Order: Streptomycetales, Family: Streptomycetaceae, Genus: Streptomyces
caccagcgccacccccgccatcggcaggaacacggcggcgaacgcgcccgggtgcgagccggcggctccggcctccaccgccccgtgcgcggccgcgcccaccgccccgccgccgagcgcggcgaaggcggcgccgccgccggccaggagcagcacgttggaaagcccgtcggatatctggagggcggcggagttggagcccgcctcctcgggggccgacagcttcagcagcaggacactggtggaggcgatcaccatgcccatcccgaagcagccgaaggcccaggcgacggcgacggtccagaccgggaccccctcgatcagcacggagggcgccaccgcgatcgaggcggcgaccagcaccatgccgctgaccatcagccgctcccggtggggctccatgcggggccgggactgcacgaacgaaccgagcgcccaggtcgccccgcccacggccagcgagagtccggccatcgtcggggacagcccgcgctgggtgaccagcatcagcggtacgaaggactcggcggcgatgaacgacccggcggcgaccccgcgcagcaggaccaccgagggcaggccgcgcgccgcccgtacggtcccggtgggcagcagtccgcggacggcgggcaccagcagggcgacgccgagggcggccggcaggagcgcgagccagttcagctcctgccccgcgtactggagcaggcccgccccggccgagatccccagcgcgagccggatccggcggcggtcgtacggttcggtggcggcggccgggtccgcgggcccggaggccgtccgccggatcgccgggagggccaggacgagcgggatcacgatgaggaccgggatgccgacgaagacccagcgccagccgaggtgctcggtcaccgtcccggaggcgagcggcccgacgacggaggggatcacccagctcgcggcgaaggccgccaggatcgcgggcctgatgcgctccgggtaggcgcgcccgatgaccacgtacagggcgacgatcaccagcccgccgccgagcccctggaccgcccggcccgcgatgaagacccacatgctggtggccgcaccggagagcagcaggccgacgccgaacgcggtgatcccggtggcgagcggctggagcggaccgcgccggtctgcccactgcccggagaggaccatggcgaacaggctggtggtgaagtacgcggagaaggcgaacgcgtagag

SEQ ID NO: 4028 - DNA, 1685 bp, Unknown
  Kingdom: Bacteria, Phylum: Actinobacteria, Class: Actinobacteria, Order: Streptomycetales, Family: Streptomycetaceae, Genus: Streptomyces
gcgccgcacagccgcccgagcagcggcacgccgacgcgaccggggcggcgggcgtgtgcgcgggccgctgtcagtggccgggtgcagactggcactgttccggcacaacggcgtttcgggaggtccaggaccatgaccgacgtattgctcaccgcaggcacccgcaagggtctcttcatcggccgcagacatggcggtgcctgggagatcacgggcccgcacttcaacgcgcaggcgatctattcggtcgccgtggacacccgcggagacgctccgagaatcctggtcggcggggacagcgcgcactgggggccgtccgtcttccactccgacgatctcggtgagacgtgggtcgagccgcgacagcccgcggtgaagttccccaagtccaccggagcgtcgctggagcgcgtctggcagctgcacccggcgggaccggaggcgccggacgtggtctacgcgggcacggagccggccgcgctgttccgttccgaggaccggggcgagtcgttcgagctggtccgtccgctctgggagcacccgacccgctcgcggtgggagccgggcggcggcggcgaggggctgcacaccgtcctgaccgacccccgggacgccgaggccgtgaccgtcgccgtgtcgacggccggcgtgttccggaccaaggacggcggtgcgagctggaccccgtcgaacaacggcgtctccgcggtcttcctcccggatccgcacccggagttcggccagtgcgtgcacaaggtcacccgggacgcggccgacccggaccggctgtatctgcagaaccactggggcgtgttccgcagcgacgatgccggcgaccactggagcgacatcggcgcgggcctgccctcggatttcgggttcgccgccgccgcgcacccgcaccgcggtgacacggcgtacgtcttcccgatcaacgccgacgccgaccgggtgccggcggaacaccgctgccgggtgttccgcacctccgacgcgggacgtacctgggagccgctcaccgagggcctgcccgacggggcgcactacggcacggtgctgcgggacgcgctgtgcaccgacgacgcggacccggcgggggtctacttcggcaaccgcaacggcgagttgtacgccagcgcggacgacggggacacctggcggcagctcgcgtcgcatctgccggacgtcctgtgcgtgcgcgcggtggcgctcggctgacggcagttgatcggagtggtcgtatcagcagtagagtgcgggccgtggcagcacgaccgttgaaagagatcatcgagccggggtgggcgaacgccctcgaacccgtcgccgaacgcgtcgccgctatgggcgacttcctccgcgcggagatcgccgcgggacgcacgtacctaccctccggtgctcatgtactgcgggcgttccagcagccgttcgaggaggtgaaagtgctggtcgtcggccaggacccgtatcccaccccgggacacgcgatcgggctgagcttcgcggtggcccccgaagtccggccgctgccgggcagtctggagaacatcttccgggagctgcacgccgacctggggctgcccaggccgtccaacggcgatctcacgccgtggacgcggcagggggtgctgctgctcaacagggcgctgaccaccgcgccgcggcggccggccgcccaccgg

SEQ ID NO: 4029 - DNA, 5796 bp, Unknown
  Kingdom: Bacteria, Phylum: Actinobacteria, Class: Actinobacteria, Order: Streptomycetales, Family: Streptomycetaceae, Genus: Streptomyces
cgcgcgggccagggcgaccccggctcctgctgctggacgaaccgctcgccgccctcgaccagaccacccgggcccgggtgcggcacaccctgcgcggacacctcgcggacttccccggggtctgcctgatcgtcacccacgacccggtcgaggccgtctcgctggccgaccgggtcctggtgctggaggacggccgggtcctccaggacgagccgcccgccgaggtcacccggcacccgcgctcgccgtgggtggcccggatgctgggccgcaacgcctggcccggcaccgccaccgccgacggcctggccctggagggcggcggacacctcgtggccgccgaacccctcccggcgggcacggacgccctcgcggtcatcgcgccggaagccgtctccgtacaccgggagaggcccaccggctccccgcgcaacgtctggcccggcacggtccgtgagatcacctcggccggcagccggctgcggctgctgatcacctccgccgaggccccggacctggtcgcggagatcaccccgggggccgccgcagagctgggcatcgccgacgggagcaccgtctggaccagcgtgaaggccaccgaggcgacggtggtcccgctgtaggcgggaggcgtcggccggtccggcccgggaaccagaaccccaccgcacacgtactccagtacgacacgacggagaaacacggagaaacggggaccccatggcactgttcggcaacgcccacacgatcaacccggccacggcccagcaggactacgcccggctgctcgggcagggcgagcaggtgcacgccgcgttcctgctgatccgcgacacgatcctgttcacggaccggcggctgatcctcgtcgacaagcagggcatcaccggcaagaagacggagtaccactccgtcccgtaccgcagcatcacgcacttctccgtggagacggccgggacgttcgacctcgacgcggagctgaagatctggatctcgggcagcgcgaccccgctccagaagacgttcaccaagggcgtcgacatctacgaggtgcaggccatactgacccagttcgtcgcccggtagcccgcaccgtccgggctcagacatacgggcgcagccgggccgccgccgagtgcccgggggcggcggcgcgcagcttcgcggcgcgctcccgcagttcgggcagcagcccgtagagcgcgtcgccgggacagcgggtctcgaagctgtcgcggtggccggagatgacgtgcagccgggccacctggccccggtcgaagcggctctcgtcgttcgtggagaccaggtcgaccgtgcccagcgggtcggccccgggccgcagtttccaggcggccagcttcaccagcgcgtccatcatcggcccgggcacctcggcccccgcgccgaagttcccgatcgccgcgatgccgaccgtgtcggtgttgaaccccttggtgtgcgcgccgagcaccgagcggccgaccccgccggcccggccctcgtagatggtgccgcagcggtcgacgaggaagttgtagccgatgtcgtcccagccgtcctgccggatgtggtcgctctggacggcccggatcaggtcgggggcgtccgcgcagtcgtagtcgttggggttgccggtgtggtggacgaacaccgcccgcgccgcgcccgtgtagtgcggcccctcccggaccaggtcctcgtccgcatgccaatcccggcggctgacgacggccggctgcggcagtccgcgcggcggtcggggtccggaggccagctccgtccccggcacgtggaacgccgggccgtccccgaacaccaggagggccaggggcaggagcagagcgcccaggacgagtcggcgggaccacatggactccaccctgcgctccggcctccggcttcgcagaggagcgggccgttcgggtgacgcaccaccgacgggagccgttgcgtccggaatgcggctgtcgccgggtcttcctacgatgagatccggatcatcgcccgctcccggcggcgatgcccggcggatcgaggaaccatggcccacgaccgtgtgggggacgaaccggcggtcggcctcaagcgagacgcgatcgggttcgtcgacgcccttgtcatcggcctgaacgcgacgtctccggcgtactcgctggccgccgtcatcggcccgatcgtcgccctggtggggatccacgccccgggcgtcatgttcgcctcgttcgtgccgatgctgctgatcgcctcggcgttctactacctgaacaaggtcgaccaggactgcggcacgacgttctcctgggtgacccgggcgatgggaccctgggcgggctggctgggcggctgggcgatcaccatgaccggcgtcctggtggtgggctcgctggccgatgtggcggtgagcttcacgctgctggcggtgggcctggacggctgggtcgacaacgacttcgtacgccagttgctcaccgtgctgctgatcgtcgtcatgaccgggctctgcgtgatcggcacggagctgtccgcgaaggtgcagaacgtgctgatcctcctccagatcgcgttcctgctggtcttcgtcgtggtggcgctctaccgggtgtacgcgggcacgaccggcttcgactcggtcgaaccctccttcggctggctggacccgttcggcgcgggcggggcggcgctgaccggcgggctgctgctcggggtgttcatctactggggctgggagtccgcggtcaacctcaccgaggagaccgagaactcggcgagcgccccgggcagagcgggcctctggtccaccgtcgtcctgctggtcacctatctgtcggtcgccatcgcggtcgtcgccttcgccggaacggcgttcctggcggagaacgcgggtgaggaggagttcatcttcgcccagctcgccggggacgtcctgggcggctgggactggatcctgctgctggcggtggccacctccgccatcgcctcgacccagaccacgatcatcccggcgtcccggaccgccctgtccatggcccgccgccaggcgctgccgcggcgcttcgggcacatcagcccccggttccgcaccccggacgtcagcacgtggtgggtcgccgggatcgccgtcgcctggtatctggtggtcaaccagatcagcgcgaacgccctcttcgactcgctcaccgcgctgtcgctgctgatcgccttctactacgcgctcaccggcgtggcctgcgcggtctactaccggcgtcatctcaccgagagcgtgcgcgacttcctgctcatcggcctcggaccggtggtcggcgccggtctgctgacctggctgctggtgcgttcggtcatcgacatgtccgacccggccaactcctacagcggcacgtcctggttcggcctcggcccgccgctcgtcatcggcatcgtgatctccctggccggcgtggtcctgatggtggtgtggcggctccgggacgcggtgttctggcaggagcggccgggggtcgccgacccggacctggtgcacgcccccgcccggaaggaacgctgagatgtcggtcgtcctcggttacgacgagtcccccggcgcggcccgtgccctgcgcatcgccatcgaggtggcggcggcgtacggggaggagctggtgctcgtctacggggccgccgcccccgggctgagcgacggcgcggagtaccgcagccactacgaggcgatccggcaggccgggcgcaccggcctggagcacgcgctcaccgcggccgaggaggcgggcgtcccggcctcggtggaggtgctggacgagaaacccgcaccggccctgctggacgccgcggagcggcacggggcccgggtcatcgtggtcggcacctggggtgagagcccgatgcgcggtgccctgctgggatcgaccccgcacaagctgctgcacatgtcgacggtcccggtgctgtgcgtaccgaccgaggaggacggcccggagccctgacccgtcggaggccgcctcccaccggtacgcgaccggagcacgcccgggaccaccgcccaccggtacgcggccggagcacggcagggaccatcgcccaccggtcctcaccacgcctcaccggtctccgccgcacggcccgggacggccctgcccccgtcgccctcctcgcggcgcagcagccggaacgccagcagggggaagaccagcaccgacaccatcgcggcggcgaccagggcggcggcctcgccggccccgatcaccttctcgtccaggccgatcgcggtgatcgcgaccaccagcggcagacaggtggacgcgaacagcccgagcgcggaccgcgaggcgcgcccggtcaggtcgcgtggggccagcagataggccgggaccccgcgcaccagcaggaacagcagcaggaagaccggcaggagcagcagcgggcgcccgccgtccaggagcgccgcgaggtcgaagtcgatgcccgtgacgatgtagaagaacggcacgaggaagccgaagccgattgcctcgatccgctccaggatctcgtcgctgcgctcgggcaccgccccttggaggacgagccgggtcagcatccccgcggcgaacgcgccgagcagggcgtccaggccgaagacgtgggcgaggcccagcatcccggcgagcagcagcatcacgaagcggaccgcgaactggccgctggagtgcagggtcacggcgacgatccgggagaaccacggcggcctgggccgcatcgcccagaacaccgcgccggccgtgacgaccgcgaacacggccagcaccgcgctcgccgcacccgggctccggccgctgaacagcagggccatggcgatgatcgggccgaactcgccgaccgacccgaacgccatcaccgccgacccgaaccgcccctccagccgccccgagtcccgcaggatcggcagcaccgcgcccagcgccgtgctggtgagcgcggtgccgatgaccaggctcttcgccaggtccgccccgctgagcagcagcgcgacgccgagcccggcggcgaacgagagtacccacgccccgccggcccggcgcagggtggagccgcggacctcggcgaaccggatctcgtagcccgccaggaagatcagcatcgagagcccgaggtcggacagggtgtcgatgacctggtcgtggtgggcccagccgagcacatcgggcccggccaggatcccgaggacgatctcgaagatgacgacggggaccggcagccacctcccggtcgcgtaaccgagcagcggggcgagaaccgccagggccatgatcaggacgagggtcccggggtgctccatcgctcgtgtatagcaaggaacaccctggaatcagccgttatgacaccctctgctccctccgggacaccgggtcagtccgggcagtggacatcccggccgggacgcttcccggtcaccaggaagtcgctgaccacccggtcgccgcaggcgttgccgttgcccaggtacatcccgtgtccgccccgctcgacggtgaccatcctggcccgctcgccgagcgccgcgcgcatcttcagggccccggccaacggggtggccgggtcgcgcaggctctggatcatcaggacgttcgatgagccgtcgtcggtgatccgggtgggcctcggctcctcgtcgtacttccagaaggcgcacggggtgatgttcacgggcatcccggccgtcagcgggtggcgcgcccggtcggcggcgacccggcccgcgtacccggaggccggccccggccagcgcacgtcgttgcagaccaccgccatcgtcagcgc

SEQ ID NO: 4030 - DNA, 3142 bp, Unknown
  Kingdom: Bacteria, Phylum: Actinobacteria, Class: Actinobacteria, Order: Streptomycetales, Family: Streptomycetaceae, Genus: Streptomyces
cgccgccacgcgcaaggtggaggccggccgcgtcgagcacgtcacgctcgcgttcggcggcgtcgcccaccggccgtggcgggcccgcagggccgaggccgagctgcgcggcgctccggccacgcccgcggcattccagcacgccctggtcgccgaactggccgaggcgcggccgctgcgcgacaacgcgttcaaggtggacctcacccgccgcctcgccctcgacgtgctcggcgaactcgcctcccggcagcccgcgcggaccgcctgaaccgcccggaccaccagaaccgcccggaccgtgccgaccgccggacgcccgaccgcgtccgcccgacgaccccgaggaaaccaccgccatgaccacccgagccccgcagttccccggtgcgcccgtcgtccgcagagaggcccgggacaaggtcaccggtaccgcccgctacgcggccgaccgcgcgcccgccggctgcctgtacgcctggaccgtcccggccaccgtcgcggccggacgcgtcaccgccgtacgggccgtcgacgccctcgccgtacccggcgtccactccgtcctcacccacgacaacgcgcccgaactccaggagcccgacgacccgatcctcgccgtgctccaggacgcccgggtcccgcaccacggctggccgatcgccctcgtgatcgcggagtccctggaggccgcccggacaggagccggggaactccatgtcgagtacgagcgcgacgcgcacgacgtgaccctcaccgacgaccatcccggcctctacacgcccgaggaggccaacggcggccatcccgccgtccgggtgcgcggcgacgtggaacgcgccctggccggcgcgagcgtccagatcgacgccacctaccggatggccgcgctgcacaaccaccccatggagccgcacgccgccaccgccgtgtgggaggacggccgcctcaccgtccacgactccagccagggcgccaccaaggtgcgcgacagcctggcccaggcgttcggtctggaccccgaccggatcaccgtggtctcggagcacgtcggcggcggcttcggctcgaagggcaccacccgcccccaggccgtcctggcggcgatggccgcccggcacaccggccgtccggtgaaaatcgccttcccccgagcccagctggcggaggtcgtcggccaccgcgcccccaccatccagcgggtccggctcggcgcggacctggacggggtgctcaccgccgtcagccacgagatcgtcacccagacctccaccgtcaaggagttcgtcgagcaggccgccgtccccgcccgggtcatgtacgcctcgccgcacagccggaccgcgcaccgggtgaccgccctcgacgttcccagtccttcctggatgcgcgccccgggggaggcctcgggcatgtacgccctggagtccgccatggacgaactggcctccgcgctcggcctggaccccgtggagctccggctgcgcaacgagccggagaccgaaccggacagcggacgccccttcagcagccgcggcctcgccgcctgtctgcgcgacggcgcggcccggttcggctggcacgatcgcgacccccggcccgccacccgccaggaaggccgctggctcatcggtacgggcgtggcatcggcgacgtaccccgtcctcgtctcccggtccaccgcgagcgcccacgccgcgcgggacggcgccctgcgcatcgccgtcaacgccaccgacatcggtaccggcgcccgcaccgtcctggcccagatcgccgccgacgcgctcggcgtcgccccggaggccgtacgcgtcgacatcggctccaccgacctgcccgccgctccgctggccggcggctcctcgggcaccgcctcctggggttgggccgtgcacaaggcggcgaccggcctcgccgccctcctcgcggagcacccgggccccctgcccgccgacgggatcaccaccaccgccgacaccgaggaggagaccggcgaggagtccccgtacgcccggcacgccttcggcgcgcacttcgccgagacggccgtcgacgccgtcaccggtgaggtccgcgtacgccgactcctcggcgtgtacgccgccgggcggatcctcaacgcgcgcaccgcacgctcccagttcaccggcggcatggtgatgggcatcggcatggccctcaccgaggactgcggcatcgacccggacttcggcgacttcaccgccaaggacctcgcctcctaccacgtacccgtctgcgccgacacggccgacatccaggcgcactggatcgaggaggacgaccgccacctcaacccgatgggcagcaagggcatcggcgagatcgggatcgtcggcaccgccgccgccatcgggaacgcggtccgccacgccaccggcgcccggctccgcgaactccccctcaccccggataccttgctgccctatctgctctgacccgacaccgcccccaccagcacggacggcccacctgttgcgcgtccggcgtactcggcgcaccctaatgagtgacccagaagtgatcagtgctcacgcttcgtgttcgggggtcgttcgtacgacggggtgaagtacgacggggtgaaacacgtgggcctcgtggtgaggagcctcgacgatgaccgttccactcgaccggcactactcggtcgaactgcaagtgtcggcagagcgcgtttcccaggtgcggcggatcgtcgccgcacaccttcgtcactggagtctcgacctgcacgtccggccggtgtgccgggccctggacgagctcctgaccaacgtccaccggcatgtcggcgacggcaacatctgcgtcctcgaactccgctggaccggacggcacgtgaccgtgtccgtcgcggacaacagtgcccggatgccccggctgctgccggccggcggcgggctgagccgggtcatggccctgagcgacagctggggcacctgccggaccacggacggcaaagtggtctggttcacccgctacgccgaggcgccgcagcccgcgggcctgctcccgtacgccccgctgcccggcgtccgcaccgcccgcaccgtccccctggctgcgctcgtgtaaccgtcccgaagggcggcccgcacacccggccggcgcggaacgt

SEQ ID NO: 4031 - DNA, 1119 bp, Unknown
  Kingdom: Bacteria, Phylum: Actinobacteria, Class: Actinobacteria, Order: Streptomycetales, Family: Streptomycetaceae, Genus: Streptomyces
gtcgaccgtggctttcaccgcgaggtctccggccaggagctcgtgggggcggtggcgctcgtctgcgagcttggcggcgaggaccgataccgtccaggtgcggcgtgccgcgaggcgcgaggcggcgatgcggatggccagaggcaggaagccgcacgcggccaccacgttcagcgccgcctcgcgctccgcgccgacccgctccgcgccgacgatccgggtgaagagctggagcgcctcctcgggtgacatcacgtccaggtccaccaggtgcgccccggccaggtcgaccatccgtacccggctcgtcaccagcgccgcgcaccccggcgtaccgggcagcagcgggcggatctgggcggcgtcgtgggcgttgtcgaggaggatcaggatgcggcggccgtccagcgtcgagcggtacagcgcggcccgctcgtccagggtgtcggggatcgccgagtcggccgtgccgagcgcgcgcaggaacgagccgaggacggtctccggctccgccgcccgcgcccccccgccctggaggtcgacgtacagctgcccgtccgggaagtgccggcgggcctggtgggcgacgtgcacggccagcgtcgtcttgccgacgccgccgatcccggcgaccgcggagacggccatcaccgagctctcggcggtggccagccggctgaccagctcggacacgaacgcggagcggccggtgaagtccggcacggtggcgggaagctgcgcgggccgcagcggggcgggcgcggggaccggctcgtccgccgggcgggccagttcctcgtcggcgcgcaggatgcgctgctggagctgggccagttcgggacgcgggtcgacgcccagctcctccgcgaggagccggcgggtgtccgcgtacaccgcgagggcctcggcctgccggccactgcggtacagcgccaccatcagcagctcgcgcagccgttcgcgcagcgggtgcgcggcggtgagcgcggtcagctcggagacggcctccgcgtgacagccgacctccaggtccaggtcgagccgcgtctcggtgagctggagccgccactcctccagccgggtccgctggttgtccgcgtacgggccggggaccgaggc

SEQ ID NO: 4032 - DNA, 1182 bp, Unknown
  Kingdom: Bacteria, Phylum: Actinobacteria, Class: Actinobacteria, Order: Streptomycetales, Family: Streptomycetaceae, Genus: Streptomyces
ggcgcgctccagaccggggcgctcggcgtccgtggcgctctccagcgcacgccggagcccggcgacgacgtcgggggcgtcgcggaggacgagtacggcgaggggctggggctttttgaacatgctcatgagtccaccgctacccggtccggcccggctgtcaccgaagttgagcaggatctgagccgtcgggccccgcccggagcgcggacccgaaaccccggtccggtctcccgggtgtcggtccggagaccggggccgtccggtcgcacacttcggtccgcagccggaggcgcgcccgcgccccggctgcgtacggtcggcgtatgactctcgacctcgacgcgtacttcgcccgcatcggctggaccggcaggccccgccccacgctggaggtgctgcggtccctgcaccgcgcccacctgatcggcatcccgttcgagaacctggaagccgtcctcggctccgccccgtcgctggcactcgacgacctggaggcgaagctcgtgcgcggcggacgcggcgggtactgctacgagcacaacaccctcttctcgaccgcgctgaggcagatcggcttctccgtgacgccgctgacggcccgggtggtgctgggcgccgcgccgggcgacatccgcccccgtacgcacatgctgatgcgggtggacgtggcgggcgagccgcacccgtatctggcggacgtcggattcgggacggtcggagccctgctggagccgatcgagctggtggagggcgccgaactgttcgacgcaccgcgccaccaccgcctggtccacgcaccgcaccacggtccgctgcccctgtgggagctccaggccgagaagggcgggtcgtgggagccgcagtacgggttcaccctggacccgtacgagaagccggactacgaagtgatcaactggttcatcgcgacgcacccgcgctcaccgttccggcaggcggtgtacgcgcagcgcacccggatcggctcccacctcgcgctgtccgggctcgacctggtggagacggccgacgacggcacgatccgggagcggcggctgaaggacggcgacgaggcgctgcgcgtcctggcggacgacttcgacatccggctcccggagggtgcccggctgccggagtgacggcaccgggcggccggagaggcgacgcccggcgacgaacggg

SEQ ID NO: 4033 - DNA, 506 bp, Unknown
  Kingdom: Bacteria, Phylum: Actinobacteria, Class: Actinobacteria, Order: Streptomycetales, Family: Streptomycetaceae, Genus: Streptomyces
ctcgtgggctccccgaacacggcgcgcgcgtcgaaggcggcacggcgggtggcccggcgcagcgccttcagcagcgtcgggccgagcgtgagggtcaggaccaccgtcagcgccgcccgtcccaggtcccagcccagcgaggtcgccgcgcagtaggcgaggaagcgcaccaggttctcgtgcagcgggtcgcccgcgacgaacgagatccccgaatccagcccggtgatgagcgtccagccctgcagattcatcaccgtgccgtacgcgaacgccgccacgcagccgtagaccgcgagcatcaccggctccgcccgcccgcgcagccggtccgctcccggcagcagtcccgcgcccatggtgaaccagcccatcgacagcatctggaacggcatccagggcccgactccgcccgtcagcagcgccgaggcgaacatggtcaccgagccgagcacgaagccgaaaccgggtcccagcacccggccgctcagcaccatcaggaagaa

SEQ ID NO: 4034 - DNA, 1618 bp, Unknown
  Kingdom: Bacteria, Phylum: Actinobacteria, Class: Actinobacteria, Order: Streptomycetales, Family: Streptomycetaceae, Genus: Streptomyces
gtgagcagccccgggtgcggtacgcggccgggtgtcccgcacccggggctgctcaccggactctcggggatcgggcacgggctgctgagggccgggttccccgaccggatcgggtccgccctgctcctgcgctcctcccggatcccctgaccggaccacggctttgacgacgacgaccaccaccaccaccacccaaaggatgaggcagagatgaagcagttcggcgaatcggccctgcaggcgtccggcgagatcgcgcacgagggcacggccgagcacccggccgggcagatctccttgggatccaccggaggcctcggtgcgcgcagcagacttctcagcgcctcggagggcgagagcggctacagccacgacctgccatggaccaccatgacggccccgtggtgaacggttccggccaacacaaccgtacataagccgaattgacccgctgccgtaggagtcggagctccagtagcctgcggccatgcgagccacttcgccggtcatcgtcgggcgggacgaggagatcggactgctgagcagcgccctggacgccgtacaacggcgttcggggcgcgcgctgttcctcctcggggaagccggtatcggcaagtcccggctggtgggcgagtgcgcctaccgggcgtacgggttcggcatgccggtactgcgcggccgggccacctcgaccgggctcgtcgtccccttccgccccctcgcggaggcgctggcctcccggttccgggccgcgggcacgccgaccgatcccgagctcgcgccctaccatccggcgctggcccggctggtcccggagtggcgcaggagcgggtcccccggctatccggagacggtcgtggagctggccgaggcgctcctgcggctgctgtccgtgctgggccgggaggcgggctgcgcgatcctgctggaggatctgcacgactgcgacacggagaccgtcgcggtcgtcgagtacgtcatcgacaacctcgccgatctgcccatcctgttcctgggcaccctgcgtccggagccgggcgcggccctggacctcgtacgctccgccgagcgccggcacgccgcgacggtacgggagctgggcccgctccgcgacgaccgggtgcgggcgctgacgggcgcgtgtctggaggcgcggccggaggagatacccgagtcggtgcaccggcggctggccgaacgcgcggcgggcaacccgtacttgctggaagtgctgctggcggacctgctggacaccggccggctccggcggacggacgacgggtgggaggcggcggagcagccgggcggtccggttccctcggacatcgtccgcagctgggcccgcaggctggagaggctggacgagccggtgcgggacctcttactggcgtcggccaccctgggcagccagttctcggtgaccgtgctccagaccgtcaccggtttcgaggaccgggccctgttcacgcatctgcggtcggcggtggaggccggtgtcatcgccccggacggcgcggcccccgaccgctacaccttccggcactcgctcaccgccgaggccctgatctcctcgctggctccggccgagcgcgcctcgctcgcccgccgcgccgccggg

SEQ ID NO: 4035 - DNA, 959 bp, Unknown
  Kingdom: Bacteria, Phylum: Actinobacteria, Class: Actinobacteria, Order: Streptomycetales, Family: Streptomycetaceae, Genus: Streptomyces
ctgtcggccagcgacgtgctgcgggcccggctggtcagcggcctggatctggccgtcctccccgccggcacggccacgccgggggagcccctcttcgcccgctgacgcctcgggcccctcccggaccgatcccggtccgacgcgcgcgaagcgcccgccgccgtgagaattgtcgggaattcggagaaatccgaccggccgatcaagctcgcgaggtggtttatgcagaagcggatcgtggcgtcagagttcctcggcaccctgctgctggtgttcttcgccgtggggtccgcggtggtcgccgtcgagtacctcggcacggtgggcatcgccctcaccttcggcttcactctcctcgcactggcctacgcactcggcccgatctccggttgccatgtcaatcccgcggtgacgctgggcatgtatatggcgggccggatcggtatccgtacggccgtcgagcgctgggtcgcccagttcctcggcgcggtcgtcggctcggccctgctgttcctgctggcgaagcagatcccgggtctggagaccagtggcgagttcggcaccaacggctacgacgaccggtcggccgtcggcatcaacatcggcggcgcgttcctcgccgaggtggtcctgacgttcctgctcgtctacgtggtcctcgcggtgacccacaaggtggcggtcaccggcttcgacgggctgcccatcggtctggcgctcgccgcgatccacctggtgggcatcccgctgaccggcacgtcggtcaaccccgcgcgcagcttcggcccggcgctcttcgcgggcggcgcggccctctcccaactctggctgttcatcgtcgcgcccctggtcggcggagcgatcgccgcctacgcccaccggctcacccacccctcccccaacgtcctgcccgaggagaccgaggacgccgtccgaggacccgctccggccggccgcac

SEQ ID NO: 4036 - DNA, 2235 bp, Unknown
  Kingdom: Bacteria, Phylum: Actinobacteria, Class: Actinobacteria, Order: Streptomycetales, Family: Streptomycetaceae, Genus: Streptomyces
gagcgcggcgagccgggcggccagctcatcggcccgcagcccggcggcccgggcgccgtcgagggcgttgctcgctcccaggagcgcctgccgggcccgctcgacggcgggggcgagccgggcgagctgcgtctccgcgctgcccagcaggggaccgagcccctgggtgaagcggtccagctcgcccttgacccgtacgaggtcgtccttggcccggttcagctcggtgcgggcccgggaggcgacggcgggctccagatcgtcccggtccaggtcgtggctgtcgacggcggtgatgtaggtgtgactgacctcgtcgatgcgccggccgagcgcggcgaagtcctcggaggccttgcggccgcgcgaggagctgtccacggcgttgatggtctcgatggagatcctgagatcacgctgggcgctgtccagctcgtagaaggcctcggcggcggcgtccttcgcggcctgcgcctcggcccgctcgttctccccgcgcccgccgaaccaccggcgcgtaccgccaccggcgaaggcggcgggcagcgcggcgagcacgagaggtacgggcaggagcatcaacgccagcaggtcccggcccccggaaccgcgcccgccgggcctccgcgacctcccggcgacgccctggcccgacaggccctgaccactctggacggcggaacttccacccgctcctgcctccggccgcgcgtgtgtcgccgtcacatccctctcccgtgccgattcgccctgcccggtacattctcccaccaggtaaggacgaacacacgggtcggttagttcgcgcttcgaacagtgacttggccgttgtcgctgcgcgccttcaccacatgagcgctgtcgtcgccgcgcggcaccccgatcgagacgtccccgttgtcggcggaagcgttcaccgcgtacttctggccgcccggcggcaggtcgatggtgatacccccgttgtcgctcacggtgtccacgaggtcgggcacggtactgaagtccagccggatctccccgttgtcggcgcgggccaccacggaggaggcggatatccggtccgcccggatctccccgttgtcgctcttcagcttcagcgcgccgcgggcgtcccggacgttgatctccccgttgtccgacgagaggtccagcgcacggtcgaacccggtggcgctgatcgtcccgttgtccgacgaggccgtcacctcgaccccacgcggcaccttcacccggtgccgggcgtcgcagttgttgatcagcgcgtcgcacttcacccggagcgtgagagtgtcgccctccatgttccagacggggtcgggcccactgcccagcaccacccacccgtcgacctgccgctccacctcgacctgcttcacgtcggccggcacgaggtccacggtggcgttctcggagtcgatggtcagggtcttcccctccagagcgaacgacttgcgctccacgggggcgccgtcgacgtccgtactcccgcacccggtgagagccagggccagcaacgcgaccccgccccccagagcgagggcccgcccggttgtcccacggagcgtgcgggtcgctgcgctcgtaacgatgtccacggtgatcggtcccccagtgcgtgctgccggacggtgccaccggacgtcgctgccggtgcactcaaaccgtatgcaccgacgacccccgacgggatccggacggctaccgtctcgtggtggggttatcccccgcacccggcccccacgaggagcccgcggaggacggcccggccccgccgggaacggtttatgagcaggggcccgggtccatgtacgctgttgcctcatccacgggtgcgtagctcaggggtagagcgctgctcttacaaagcagatgtcggcggttcgaaaccgtccgcgcccaccagcacgaaggcccccgaccgatcatggtcgggggccttctgcgtcccgctcacgcccacggtcaacgcgtgcggtcactcaccgcctccgcgatcgacaggctgttctcgtagaggtggtgccgggtgatccggccgtcctcgacggtgaggcgcagtgcgaacggaccctcgaaggatctgcccgtcgcgcgcacggtccccgacaggtggcccgtcaggacggcgtcgacgccgtccacgaggaaggcgtcgacggaggcgcgggcgtcctcgggcacggtgtgctccatcaactccgtggactgggccgcgcattcggcggccgtgga

SEQ ID NO: 4037 - DNA, 777 bp, Unknown
  Kingdom: Bacteria, Phylum: Actinobacteria, Class: Actinobacteria, Order: Streptomycetales, Family: Streptomycetaceae, Genus: Streptomyces
tgccggaacgttccggcacggacagaacctaaccttgccggaacgttccggcaacccttcgtcgggccggaggcgaacgtctagacttcacccccgtgacctcccggaccgtgaccctgctcgacgtcgcccgcgccgccggggtctccaagagcaccgtctccgacgcgctccagggttcgggacgggtcgcggaagccacccgggaccgggtccgcgcggtcgcggagcagctcggttaccaccccaacagcgccgcccggcggctgcgccgcgccggcaccggagccgtcgggctgcatctgccgacgaccgcgacccggctggactactacatgaacctcgccttcggggcggtggagcgcgcccaggaggacgggctcgacatggtgctgctcgccccctccggggcggcgggcgggcggatcgcctcacgcgtcgacggccttctggtgatcgaccccgagcccggcgacggcgcggtgccgggactgctcgacgcgggtgtcccggtggtgaccggcgagcgctacctcggaccggccaccggtcccagcggcgccgtggtctgcgacaacgccgcctcgctgaccgccctcctcgaccatgtcaccgagcgcggcgcccgccaccccgcgctcctggccccgtccggctcctcggcctgggcgaccgccctgcgcgcgacggccggatcctgggggcgggcccacggggtggcggtggccctgcgcaccgtgccgttcgcggcgaccccggccgagggccgaggccgcc

SEQ ID NO: 4038 - DNA, 1151 bp, Unknown
  Kingdom: Bacteria, Phylum: Actinobacteria, Class: Actinobacteria, Order: Streptomycetales, Family: Streptomycetaceae, Genus: Streptomyces
cttgctggatccgccgcgccacgaccggcgcaccccctgcatatggacatacagcgaccttcctggctgaatagaacggtcggcgccggtcgtggcgcggcggatccagcaaggggacagcatgagtgggagcagccccgccgcgcggttgcagcggctcttcgagggccaccggctcacgcccacccagcggcgcatcgcgcactgcatggtccgccgggccgccgacgctccgttcctctccagcgtcgagctggccgagctggccggggtcagccagccctccgtcacccgcttcgccgtcgccctcggcttcgacggctatccggcgctgcgcaggcatctgcgcgaggtcgcgcccgccgacgcggagcaggaggacgcgggggagacgtacaacgagtaccagcaggccgtccgcgccgagatcgagaacctccagcacctctccgacgtgctcgccgaccccgcgcccgtcgagcgggccggccggctgctcgccggctcccggccgttgccggtgctgggactgcgcgccgcctcctcgcaggcgcgcggcttcggctacttcgccgccaaggtgcaccccgacgtccgggtcctcgacgagggcggcagcatgctgcccgaccggatcgactccgcccgaagggccggggccaccgccctgatgtgcttcgcgctgccacgccaccccaaggagagtgtggacgcgctcgcgtacgcccgggaccagggcctgaccgtggtgacggtcgccgactccgccttcgcgccggtcgccaagcacagcgatctgctgctcccggcggcgatcggctccgggctctccttcgacaccgtctgtgcgccgatgctgctcggccgggtgctgctggaagcgatgtgcgacggactccccgacgcccaggcccggttggaggagttcgacgcccgggcggcggcgcgcggtctgttcgtggagtgagcgctccgcgcccggccctttcgcgccttctcaggcgtcgctcatctgcggccgttaatctccgcgcccagaagcaccgcggcgacgcggcgtcgtggagagaggggtacggacgtgggacgcggagggcagtcgctggcgagggtggccgtgacggtacgggccggggcggcgccgctgtggt

SEQ ID NO: 4039 - DNA, 515 bp, Unknown
  Kingdom: Bacteria, Phylum: Actinobacteria, Class: Actinobacteria, Order: Streptomycetales, Family: Streptomycetaceae, Genus: Streptomyces
ttgccccgtacgaccttgatcatcggcagacctttctgcgaacgggcgaacgtacggctgcggctagagcgggatgttgccgtgcttcttcggaggcagggattcccgcttcgtacgcagctgacgcagtcccttgacgatatgggcccgggtgtcggacggcatgatcaccgcgtcgacgtagccgcgctccgccgccacgtacgggttgagcagcgcgtcctcgtagtccgccatcagctcggcccgcgtcgcgtccgggtcgtcggcggcggcgatggcccgccggtgcaggatgttcaccgcgccctgcgctcccatgacggcgatctgcgcggtcggccaggcgacgttcaggtcggcgcccaggtgcttggatcccatcacgtcgtacgcgccgccgaaggccttgcgggtgatgacggtgatcagcgggaccgtcgcctccgcgtaggcgtagatcagcttcgcgccgcgccggatgatgccgccgtactcctggtccacgcccggca

SEQ ID NO: 4040 - DNA, 1459 bp, Unknown
  Kingdom: Bacteria, Phylum: Actinobacteria, Class: Actinobacteria, Order: Streptomycetales, Family: Streptomycetaceae, Genus: Streptomyces
ccgaggtagacgacgcccatgccgcccgcgccgagccgccggtgcagccggaacgagccgacgagacgcgggtcctcgcgccggagccgcatcatcgccatcgtctgcccatccccgctgcctggtccgcctgacgaggcacagcttacgtaccccgcgcccggcgcgctcagaggccgcgccctcgccggggattcgattgtccgtgccgggcgggagaggtgaagaggggtcagagcgcggcggatccgggcctctcggtcggccggcccgcccaatgaggccccggtcaagggggattggatcatcgcgggaacaccggggcgcagccgtcacgcaggcctttgcagccgccctggcatacggggcggtggtgtccggggtggcccccggcgcccgggcggccgcacgccgggggcgttgggcgtgagtgaagtcacccggccgaggtgaccgcgaggtcgacggaggcgtaccggacgggtcccggcgtcccctccgggatgaccccaacctccgatggtccgtctccacccaggggagtacgccgatcggcgacggctcatcctccgggaggcccggtattcggtacgcgggcatgacgccccgtgctcgccgcttacctaatgttgaggtcaagcggcgggcgcagcactcgtcccccgaggtcacacgcccgccgctccccatcaggtcaggagaggaaccatgtcggacacggcaacgcggacgatggtccgtacgcagggacgcaaggcgtacgccgcgttcggcgcccgttcgtccggcacccgtcaccccttggtggcgacggcgatggttcttcccctggcggccctgctcgcggtcgtcttcggcggctgggaagcggtggtcacacaggcgtcgtccgtggcggtgatgctggggcgctgagcggcgtccagggtccggaagagcggtccggacccgcacatccggccaacagccccgtggggacgggggtgcggcggacggcagcgtttgtccggtcagctggggagctgaccgggcatcgcgctgtccgggcccatgtgtttccccgccgggccgacgcaagcacgggccggaccggcttcagtaccggccgaccggcttcggcaccggcgctgcggcccggcggtgagacccgtcgttccggcccgggtccgcctccgtcgttccaagccggggcgtcggcttccggaccggtcggcttcccgggagggccctcgcgttacgctcacgcgggaccggcgccacggccgggccgaccgccgggggagccgttgaccaccacccagacctcagtcgtccatgacctgggcaccctggcgcaccgcctctcccaccccgccggggcgcgttgcgtgtgcgagccgccgcaggtcctcgcggaccggcccgacggcacggtcgtccgcagtggcgcgatcgtcgcgaaggcccacgccgccgacac

SEQ ID NO: 4041 - DNA, 726 bp, Unknown
  Kingdom: Bacteria, Phylum: Actinobacteria, Class: Actinobacteria, Order: Streptomycetales, Family: Streptomycetaceae, Genus: Streptomyces
agaccgcccaccccgacgcccggctctccgcgctcctcgcggtgatctgcgcctggctgatgtacctgctgatgcgcaccggctacgcggtcggccaggtctgcgtcgccgcgtacgtcgtcttcctgctcggcatggccggcgacgactggtcccagaccgtcaccgagcgcatcgtgctgacgctcgtcggcggactcctcgcgatgatctcgtacgccgtctacccggcctgggagaccccgcggctgcgcgaccggctggccgagtggctggtggcggacgtggagtacgcggccacggtcgtcgaccggtacgcggaccccgccgcccgggacgccgaggacgtccgggacgccctgatcgccacccgggaggcccgtgtggcgtggcaggaggcgctggcgaccgcccagcacgaacccgtacgccaccggggcatctcccgggccgccgccaccgacgcccagcacgcgctggcccagctgggccggtccgcgatggtcctggaggcccatctgccggcccggtcggccgacccggtgcccggcgccgccgagctggccgaggcgttgcgccgggccaccgagaaaggcgccagggcggtacgggagcggcggctgcccgactggcagccggtggtggacgcggtggcccactgggacatgcccaccccgacggaggacggcacgacgccgatcggcgacccggtcgtgcgccggggcg

SEQ ID NO: 4042 - DNA, 3098 bp, Unknown
  Kingdom: Bacteria, Phylum: Actinobacteria, Class: Actinobacteria, Order: Streptomycetales, Family: Streptomycetaceae, Genus: Streptomyces
gcgggggcggcgacggccggggcggtggccgcggcggtgacggcggcggtcgccaggaggatcgaacgacgtctgggggcaacggacatgacggctcctcgggtgggtggagccaccacggaagcgagggcggatgacggcccggcgtacggtacccggccctgcgatgtcctgttggccacgggtgcacaccgcgccggaaccccacacgggaacgccggacgccgaacgccgggctccaccccgatcgtacgaggaggagcccggcgttcgtagaggtcgtgcgggaaccgctgccgcgaggcgggcgggaactactgccgctgcgccggcatcccgtccgcgccgtcgctgtcgccgccccgccgccgctgacgtacgaggccgatgccgatcagcaccacggtcagcgctcccgtggccagcaactggtcccgggtggccggctggcgcagcatcagcaggaagatgcccaccatggccgccagggcgacgatcgtgccgacggggaagaaccacatccgcacgaccagcttctcgggcgactcacgctcggtgcggccgcgcaggatcagctgggaggccgcgatgaagatccacaccaccaggatcaccgcgccgatcatgttcagcagccaggggaagacgtcgtccggccgccagtagctgagcagcacgcacgcgaacccgaagaccgaggagaacagcacggcgttgcgcggcaccccggaggagatcttcccgagcacggccgggccctggccccgggcgaccagcgaccgggccatgcgggacgcgccgtagatgttggcgttcatcgcggagagcagggcgatgaggatgaccacgttcatgatctgcgcggcggacccgatgccgaggtggtcgagcatcgcgtagaacgggccgacctcggcgaccttcgggtcgtcccaggggaccagcgtgacgatgaccgccatcgagccgatgtagaacaccgcgatgcgccacatcgccgtacggaccgccttcgcgacgccctgcaccgggttctccgactcggccgccgcgatggtgacggtctccagaccgccgtacgcgaagacggaggcgaggagtccgatgatgaacccgtccatgccccgggggaggaagccgccgtcccccgtgaggttggagaggccgggcgcgtccgtgtcgggcagcacgccgaggatcgccagcaggccgagcacgaggaacagcgtgatcgcgatgaccttgagcgcggcgaaccagaactcgaactcgccgaagttcttcacggcggccaggttcgtcccgaggaagatcaccatgaacagggcgacccaggcccactccggcgtccccggcagccagccgctgacgatctgcgcggccccgatgccctccaggcccacggcgacgcagagcaggaaccagaaggaccagcccgcggtgaacccggcccacggaccgatcgcccgctcggcgtgcacggagaaggaaccggacgccggattggcggccgacatctcgccgagcatgcgcatcaccatcatgacgagcagcccggagatggcgtaggcgacgatgatcgagggccccgcggcggcgataccggcgcccgagccgacgaacagcccggcgccgatcaccccgccgagggcgatcatcgagaggtgacgctgtttgagaccgtgggtcagcgcggagtccgccgagtggccggcgggggccgcggcgtcagcggtggggggagacgcggaggtccgaggcatggacgagctctgttcggtagctgagacgggggacgaacccacagtctgagcatccgtaccgctcacacggaacaggtgtccgctatacggtcaccaggctcacacaaggtgtgcacccgcctaccggccggtaaggccgatcgctcacacacccgcctaccggtcggcaacggccgaccccctgcgctcccgccactgccgacccaccgccaccagcagcaccaacgtcgtcgctccggccgaccacagcacctgcgggcgcgccgcctcgtcggtcagcatcagcaacagcaccccgagcagcccggccagcgtcatccaggtcagatacgggaagcaccacatccgcagcgagagcgcctcgggagcctcctgctccagccgggcgcgcagccgcaactgggaggcggcgatcagcgcccacacgaacagcagcaccgcgccgaccgagttgagcatgtagaggaacaccgtgtccggccacagcaggttgagcaggacggagacgaagccgaaggccaccgaggcgagcaccgcccgccgcggcaccccgcccgccgcctctccggagcccccgcccgagaccttcagcagcccgcgcggggcctccccgcgctccgccagcgagaagaccatgcgggaggagccgtacagattggcgttgagcgcggagagcagggccacgaacaccacgatgttcatgatctgcccggccgacggcaccccgatcgcggccagcaccttcacatacgggctcaggcccgcctgctgcgcggtccacggcagcacggtcacgatcaccagcatcgaaccgacgtagaagaagaggatgcgtaccaccgcgctgcgcaccgcacgccccaccgcgcgcgccgggtcgtccgtctcggcggcggcgatggtgacgacctccagaccgccgaaggcgaagaccacggtcagcacgccggagacgaccccgccccagccgttcggcaggaagccgccctggccggtcaggttggacatcccgaccggatcggtgtccgggagccggccgaggaccgccagcagcccgagcaccaggaagaccacgatcgcgccgaccttcaaggaggcgaaccagaactcgaactcgccgaagttcttcaccgccgtcaggttcgccgcggtgaagaccaccatgaacagcagcacccacgcccagggttcgatgcccggcacccagccatgggcgatctgtgcggccgccgtcgcctccacggcgaggaccaccaccagcaggaaccagtacagccagccgacgctgaacccggcccaccgcccgagtgcccgctcggcgtgcaccgagaacga

SEQ ID NO: 4043 - DNA, 2185 bp, Unknown
  Kingdom: Bacteria, Phylum: Actinobacteria, Class: Actinobacteria, Order: Streptomycetales, Family: Streptomycetaceae, Genus: Streptomyces
ggggtggaaggccaggtggcgcgggccgacgcccggacgcagggcggtctcgccgtgcaggcgcagggagccggtggcggggtccagggcgcagacgcgtaccgagtcggtgccgaggtccacgctgaccacccagttcccggaggggtcggcgagcacctggtgggcgtgcggggcctcctggcggccggcgtccgggccgctgccctcgtgccggagcaccgaggccgccactccgagcgatccgtcggcgaggaccggcagggcggtgatgctgccggaggtgtagttggccgtgaccaggtggttcgcggcgagcgcgaggtgggtgggcgcatcgccgtcgacggcgccacccccagcaactccgccagcgccacgagcttggtggccccccgcgaggaaagcaccaccagcatccggaactgcggcagcgtcacccggtcctcgacctccgccagcgaacgcgccgacaccgcgaccagcaagcgggaagccgtcagcaccgctccggtcaccgcgtccacatcgtccatgcgctccgcaggagccgccttcctggccatggcacctttctaccctgctccgggcccggcgcgccccgccccctcggccttcgcaccccaagatttagactatgcaaagattgcacaaactaagagttgagtcgggccgcactgtgccgtcggctcccgtccgcgtccagaggaggcgttgtgatgacgtcacaacaacacgcccggcgcagccgcccgcccctgccgcgcggctggcggcgacgcctcgcccgcctgcccctagccttctaccgcgtgggcctcggcccggtcttcggccggcgcctgctgctcctgcaccacaccggccgcaacagcggcctggaccggcgggtggccctggaggtcgtcgcgcacgaccgcgcggagggaacctggatcctggcctccggcttcggccccgaggccgcctggtaccgcaatctgcgcgcctcgccgaagaccacgatccaggtcggcaaccgccactacgccgtcaccgcacacttcccgaacgccgacgagggcggcgagatcatggccggctacgcacccgcccacccccgcaccgcccgtcggctgtgcgctttcatgggcttcgacgtcgacggcagcgcggactcctatcggcgggccggccgccgcatccccttcgtacgccttgaggcggcccccggccagcgcgtgcgctgacgagccctcggacacgtccttacggacccgtgacgtgtgcgcgccgcgcccggcccgacggttggccgggccctagcgtggcggtcatgcgcgtactggtcaccggcggagccgggttcatcgggtcacatgtcgtcgccgccctcgccgcggccgggcacgagagcgtggtgctggacgccctgctgccctcggcccatcccggcggcacaccgccggagccgccgtgcgaccggatggtcgtcggggacgtccgggaccgggaggcggtggcggacgcgctggccggggtggacgccgtgtgccaccaggcggccatggtcggcctcggcaaggacttcgcggacaccccgctgtacgtggggtgcaacgacctcggtacggcggtgctgctggcggagatggcagcggccggggtccgggacctggtgctggccgggtcgatggtggtctacggcgagggccgctacgcatgcccccggcacggcacggtccgtcccggaccgcgcgcggaggccgatctgcgggcgggggacttcgagccgcgctgcccggactgcggagcggacctgacgcccggtctggtggccgaggacgcagccgtggatccgcgcaacgtgtacgcgtcgaccaagctggcccaggagcacctggccgccgcgtgggcgcgggcgacggggggccgggcagtctcgctgcgctaccacaacgtgtacgggccggggatgccgcgcgacaccccgtacgccggtgtcgcctcgttcttccgctcggccctggcgcgcggcgaggctccccgggtctacgaggacgggggccagcgacgcgacttcgtccacgtccacgatgtggcggcggcgaacacggtggccctggaggcggtgcggcagcggcggccatctccccgatggtgtgcggctcgtcgctgccggtgttgtacgcggcgaaggacgcgg

SEQ ID NO: 4044 - DNA, 3557 bp, Unknown
  Kingdom: Bacteria, Phylum: Actinobacteria, Class: Actinobacteria, Order: Streptomycetales, Family: Streptomycetaceae, Genus: Streptomyces
cgccgacaccggccacgacgtcgtcgagatcctgctcgacgcgaccgcccggcagcatgtccagatgcgagcgccggctcgcggaggccagggcgctgcccgtcccgtcgaacgcgacggccttggtgaccgacgtcccgatgtccacaccgatgatggtgctcacgcctggtacctcctgtacgagcggatacgagcggatgggttcccgggcgacggggagcggcgacggcggcggcggccgtcagggccgaccggctgccaggacgtcgtggttcgcgaggtgggccagtttctccccgcgcaggaagcggccgacctcggcggcggtgatggccgccgctcggtgcgccgtctgccgggtcgcgcccgcgagatggggtgtggtgaccacgttcggtacgtcgcgcagggcccagtcggcggggatcggctcgatgtcgtacacatcgagggcgagtgccccgagagcgccgctgcgcagcagctccggcagcggcgcgtggtcgagcagtccgccgcgggcggagttcaccaggaccgcgccgtgcggcagcagtccgaggcggcgggagtcgatcaggtggtgggtctcctccgtcagacgggcatgcaggctcaccaccgaactccggctcaggagggcgtccagctcgaccggttcgaccccgtccgcctcgaccgccgcgcggtcggcgtacgggtcggccgcgagcacgtgggccccgaaggcgcgcatcacccgtgccacgatgcggccgatggcgccgtagcccacgagtccgaccgtggcgccgccgagctcgccgccgctctcctcgtacgcgtacagatcgccccgccagactccccgcttgagctccgcgtcggcggcggggatgcggcgcatcgcggcgagcatcagtcccacggcgaactccgcggcggccgtggcgttgcggccgggggcgaagctgaccctgactccgtgtcgggtggcggcggccaggtccacattgaccggtccgccccgggagacggcgacgaggcgcaacccgggcgacgcggcgaacacccgctcggtgaacggggccatctgcgtcacgcagaccgaggccccggccagcgccccgacgagctcgtcctcggtgccactcgcctcgcggacctccgcgaccggaccgaagggctcgtggggccaggggagggtcagctccgtgaactccgggagctcccggcccgtgcgggacagctcctggctcactgccgcgcgaatcagagcgggacggacgaagtggtcgcctgcggcgaggatgcgcatgacgtcggattccttctgcgaggagagccggtgggattgcgtggagagcaggtcggagcgtgatccgagccgcgacaggccggtcctgggctgtggaatttctgttaaatttaacagcgctcacgtgaaccggcaatgagcccggcgcgcccggcgcgtccggattctgcttctgcatcgactcgacctcgaccccgacctcggaagggcggcctccatgacctctcgtctcctgctggtgcgccacggcgagaccgagtggcacgcggagaaccggtacgccggagtcaccgacgtcgccctgacgcccaagggtgtggcccaggcagccgacctcggatcctgggccgccggcagcggcgtggacgcggtcgcctgctccccgctcggccgcgctcgcctgacggcggctcccgctgcggcggcgctgggcctggcggtggacgtccaggaggggttgcgggaagtggacttcggatggggtgagggccggaccatcgcggagatggccgaggaggaccccgaagccgtacggcggtttcgcgaggacgccgactcgggcgccttccccggctccgaacccgtagccctggccgcggcgcgggcgaccggctccctgcgcgacctcgcgcaccgtcatcaggggggaacggttctcgtcgtcgcccacaacaccctgctgcgcatcgccctgtgcgaacttctcggactgtccctcgggcgctaccggcggatcttcccgcgactggacaacggggccgtcacggagatcgagatcagcggcacggaaacggcgctgcgctcgctcaacgtacccaccgcccccgcgcccggtccgagccctgcgggagactgatccccatgaccaagagatccgccgaagaacggcgacggctcatcgccgaccatgtcgtggagcagggcacggccacgggcgccgctctcgcccagctcgcgggcgtgagcctgatgaccgtccaccgcgacctcgacgacctcgcgcggcaaggcgtgctgcgacgcttccgcggcggcgcgtccgccctgccttccacggtgttcgagtcgagcctcgactaccggctcggcgtcaacacggcggagaagaacgccgtcgcgcgcgccgcagccgcgctggtggagcccggtatgtcggtgatgctcgacgattccaccacggtcctggtcatggccggcctgctggtcgacctcgctccgctcacggtcgtcaccaacgcccgccgggtcctcgacgtcttcaccgggtgcgagggcatccgtctcatcgccctgggcggcgagtactcgcgcacccatgactccttcctcgggatgccctgcgtcgaggcggtggaggcgctctccgtcgacctcgtcgcggtctccacctcggccctcgacgccaggacggcctaccaccaggagcaggacgtggtgctggtcaaacgggcgatgctcacgtcggcggcgacgaaggtgatgctcatggaccacaccaaactcgcccggaccgcgctgcaccgggtggggcccgtcggtgacctggaccatctcgtcgtggacgacggggcggacgccgaactgctcggcaaactccgggagcggacccgggtgacggtggcggccgtcgcaccctgaagtcgttcctcccgccgggaggctgttcctcccaccatgatggaacgcatgttaatttcacacgcacgcagccatcgcgacggaccgcccacccgatcggtggacacctgaggcccgtcccgccggggaaggacgctttccgccatgagcagtgcatcccgtcgcaccccccttcactccccggccgtgatcggcgtcgacgtggcgaccgcgtccgtccgcgtggtgtgcgtggacggtcaggggtgcgtactcgccgacgcgcggggcgaactgccgtcccccgtacggaccgccgcggggacgagcgagcaggacgcccggacgtggtggcccgccgtacggtcggcgctgcgccgcaccacggccgcgctgccccggggtggccgcgaggtgatcgcggtggccgtgtccgccacgtccggaacgatcgtgcccaccggggccgacggcgtcccgctcggcccggccctgatgtacgacgaccggcgggccgccgacgtcaacgccgaggcgcagcgggtgggcggtgcccggtgggacgcgctcggcctgtccgtgggaccgaccgcggcgttgggccgagccgtctggtgcctgcgggcgtacggctcgggcc

SEQ ID NO: 4045 - DNA, 2648 bp, Unknown
  Kingdom: Bacteria, Phylum: Actinobacteria, Class: Actinobacteria, Order: Streptomycetales, Family: Streptomycetaceae, Genus: Streptomyces
ggcggagggaggtgcgcgtcggggggtgggcaacggtcatgaggcgatttcgccgctcatccggcgctggagctcccacaatgactggaaaagcccgggggactgggtgagttggacgtacgtgccttcctggacgatccggcccttgtccaggactacgatccggtcggcgatggccacgttggtgagccggtgcgtgatcagcaggatcgcgcggtccttggccagttcgcggaggccggagaagatcctgtactcagcccgtgcgtcgagtgccgccgtcggttcgtccatcaccaccagcgccgcctgccggtggaagacgcgggtgagtaccaggcgcagccactggcccccggagagctgttgcccgccgaaccactcgctggtcaggagggtgtccaggccggagcggaggttgggcagcatctctgaggcgccggatgcctcgcacgcggcgagcagtgccgcgtcgctcgtgtcgccctggccgaagctgatgttgtcccgcatcgtcagcggcaggtgggtgaacttctgggggaccagggcgacttgtttccacgcctgccaggggtccagttccgtcgtggaggtgtggtcccaggccacttcgccttcggtgggaagaaggagtccgcacaggaggcgggagagggtggatttgccggagccgttctccccgaccagggccacgatctcgccgcgccgcacgtgcagggatactccgctgagggcgtccttcggggcgccgtcgtagcggtaggtgacgtctcggacctcgaagcgctccgggggcgcgggcaggggcgcggtgccacgggagtcggccatggcctggccgtgggcgttgtcgaggaagttctgccagtcctgtgcgtaccagccggtgcgcaccagtcgcgcccctccgctgatgatgccgcgcacggagccggtggccgtctggagagcgaagacggcgccgcctccggcagccaggctcatgcggccggaggccaggagccacagcagggccgcccacactgcgatcgaggcgaccccgccggccagagcaccggccatgcccatccaggcacccgtgttcgcggccttgcgctcagccgcgttgacggaggcggcaagctttcggtaccggccgatcaggaacgggccggccaaacaggcgcgcatctcctcgctggattccatgtacgccatgtgccagcgcagcttgctcaacatccgccgccgcccggaggtctccagacccgccaggtagatcacgcgcgcggaccggacgtaggcggctgcctgcggcaggcacgcaaggaagagcagcggcaggagcagcgggtgcagaacggtcaggacggtggcgccggccgccagcgtcgcggtggccgcgagcacaccctgagcttcttccaccagatcgggtgtgacctgggcgccgcggtcagcgatgtcgtaggcgtcgttgtagccgggctggttgttggcggcgagttctgcgccgagcgcggcctcgaccatcgtcagctccgccgcccgggcgagaaccgggcgcagacgcccggtcagccagaccacgacgatgcccagcagtgcacgcagcccggtcgccgcagcgatgacagccagctgcggagcggcgtcccacagccgctcggtgatgacgcccgaggagatcagcgcggtgatcgtccccgtgacggccaggaggccgagagccgcgaggacgccggttccgacctggcacaccagcagcccgaccgttgcacggcgatccacccgccatgccattctcacggaacgcagcacgagcacgggcagtcgccgggccatcgtgcgggtcgtcaacagcgatcccgcctggagccgggactcgtctcggtagaggaactcctcctctcgaacaccggcctcatccggttcctcgttctgcgaggtgccgttgggctgcttcggcggctgctctggtgtgatggccgaggtcatcgttccccctaggacggtcgctgcggctgagtcgtgaggaccaacgacccagcagcaatttcgaacacacgtcattcggtcgcgctcggggccccgcaatcacgggggtgcaagagcgccgcgagccgcgagccctgttccggcccgggtcggctgtgggctcggaatggccaaaacgccgacaccgtgcgtatcaggccgtcccgaccggcgcggagcccacgtggtccccgacacccggcaggtaagccggaagaccggtcgggcatcgcacctccgatttcgacatatcctccattccggtccctacgagttggcgctggtccggctggtgaggtggcgttcccagacgtccacggcgagcgatgtgggcatcccgcagggctttctccgggggtcggtccatggcaggcacgagcgagacgtctgtggactgagttcgggaagcgatcgaggggatggccagtcgtgccgtcggcgcactcggcacgatgctcgccgtgcttctggtcctccccgtcaccacccacgccatcaccgacgcgtggatccagaaggccctgcggtgcgtgcacacctgcacggccgaggcggccgaccggctcgccggctcgccgaccccgtcccccgggtcgccgaactggaggtgctgctcggccgggtccggc

SEQ ID NO: 4046 - DNA, 2258 bp, Unknown
  Kingdom: Bacteria, Phylum: Actinobacteria, Class: Actinobacteria, Order: Streptomycetales, Family: Streptomycetaceae, Genus: Streptomyces
ccgtgcggcccgacccggtgagcacgaccggtgggagcgacgactacctgtgaggcgcgcgccgcccgggggcggtggtgcgtacggagtcctcgccgagggcgaggctcagccggtcggtgagttcgacccggccggtcgccgtgagccgctccctggtgcggccgccgtgtctgcgcagcacggcaccgccctcggggctgcgctgcacggcgtaccggccgttggtgcgccgttcgatgcgcgggttgctgtgcgcctcggcgacgtcgaacgcgtaccactgcttctggccgtgtccggccgtgtggacgccgagcacgtcgccgtcctcggagagcaggtggagcgtcagcccgtgcgggtcgcggcggccccgccgctgccggagccaggccagcaccaccaggacgccgacgacgatcagcgcgacggcgccgaccagcacccaccagtaccggtccagcaggctgggttcgggggtgacctggacggacagcggggtgcgcaccagggtgcggtcgccgtcggtggcgtcctggacggtgacggtgccgccgatgccgagcgggccgtcgtcgagccgtccgtcgaaggacttctccggtccgatcccgagcctgatctcatgggtggaggacgcgccgggcttcaccacgatctcggccgggctcacggtgaggagcccggcccggacgtccgcgagggacagccgcagggtgtgcggagcgtcggtggtgttggtgacggagaggttcgcggtgaccgtgtccccggggtggccgtcgccgcggaccgggccgagcgccgtggtgacgggcagggctccgggggcgacctggccgccctcgctgcgggtgtcggcgctgagcccggatgcggtgagggtgccgctgaccttcagggcgccgtcggcgctcttcgggacggtgaccgtgccgctgaaggagccgtcgctcctcgtcaggtcgggcccctcgccgtcgtcggcgagccgcaggggcagcggggcgaagccgtcgccggtgagttcgctgctgaccttcagtcccgcgtagtcggccgggtccttgatctcgtaaccctcgcgggtctggagccgcatggtgacggtcgccttctgcccggcctgcggggagggcgggtccatcgtgatggagccgcgcagctccccctgccacaggacgctgacgccgacgggcagcgagcggtggccctcgggggccttcacgtcgaccttccaccggccgggcaccgggtcgacgatcttcagcgcctccaccgtgccgccgccgcccgcgagttcgaaggtggagtccttgaacttcccggtggtgggcaccttgttgccgagcgggtcggtgtaggtgacggtcacctcgggggagcccttgtcgacgacgatgctgcccacggtcgccagcggcgagatggtgatgggcagggtggcgggcgggcgcttgctcggccccggctggtagcgcaggcagtgcgcggcggcgaagatcttctccagcaccggcccgacgtccttggctccggagaccttgcgggcggtgggccgggcggacggcaggtcgacgcagcccttctggaagccgcccgcggcgatcttgtcgagctgttccttgtccgggtcgggaccgaagccgagcggccagatctgtacgttcttggcggcggcgttcttcagctccagctccagctgccgcttcccctcggcctcgcggtgcgccgggtccccgtactgggggcttccggtgacgtccatctccccgtcggtgagcaggaacagcacccgggggaccgacggatcggtgcccgagctcagttcgtgcacgccctggcgtatcgcgctcgggaagtccgtcccggtgccctcgctcttcttgcggccgcgcagcttctccacgcagcccccgaccgactcccgtcccgccgcgtccagtcgggtacgggggcacacggggtccaccgcccgttggtcggccgactcggcggcggcgaagccgaacacgctgatgtgggaggccgccgagacgtcgccgagcgcgatccgggcggcggcggccttctccgccttgatgtccgcgggcgcgaggctcgcggactggtccacggccaccgcgtagttgacggaggcgaacgcgggcgcggcggccgcgaccggctccggatcggcggcggccggtgccgtcagggaggtgagcagggccgcaccggccaggacggccagcgccgcccgcccggcccggccg

SEQ ID NO: 4047 - DNA, 1446 bp, Unknown
  Kingdom: Bacteria, Phylum: Actinobacteria, Class: Actinobacteria, Order: Streptomycetales, Family: Streptomycetaceae, Genus: Streptomyces
accccgtccgggctcgcgcggacggaccacgaggtggctgtccgtcgttgcggccgccggcggagcgaacgggtcctgcggtgcgacggcggcgggcgcgaccgcttccggtacggagggcgtcagggggacgggggtgacgggcggcggtgtgtagcccggtgacggctgtacgggcgtgggcccgggtgcgagcggcggtgccggggaggccggtgcggccggtgccggtgccggggaggcgggcgcgggtggcgtcgccgctggcgtcgcgggagctacggctgcgcggtgggccggagccggggggttctcgcggggctcctgcgcgatcaggtgccggggcagcaggacgaccacaccggtgccgccgcgcgaggacgggcggtagttgacgctgatccggtgcttgagcgcgagccgtcccaccacggcgaggccgagccgggtgccctggagggtcgcgaggtcggtggtccgcccggcgacggagtccgccgcccgtcgcatcgccgcgtcggccatcttcagaccgctgtcctcgatggtgacgacgatgccggtgccgcgctcctcgacgtagacgtgcacctcgtcgatgggcggcgagaagttggcggcgttgtccatcagttcggcgagcaggtgcatgacgccttcggcggcgaagccggagatggagacgctggacgagcagtgcagccgtacgcgctggtaggcggcgatgcggccgaccgcgccgcgcaggatgctctccatgacgatcggcctgttccaggcgcggctcggccggccgcccatcagcagcgccagccggtccgtcatcagaccgagctgcgaggtgctgtggtccagcttcagcagatccccgaacacctcttcgccgtgacgttcctgcatgctccgcagatcggcgagcatgctgacggatttcgcctggacccggctgagcgccttggccgacgcggtcgtcgccgcgagagcgcggcgctcgctgagcgagagctcccggagcaccgcctcgaccgactcgcgcaggatcggctgttccggcagatacacctcggactgcaccgtggtgcctgactcgccgtcacggagcctggcgaccacgcccggaagcgtctcgcgggtgaaccgttccacctcggaggtcagcgcgtgcagttcctcgcggagccgtacgttctccgctcccagctcgtcgtggacccgggtgctctccgtccgcagtgcggcggcctgctgcgcctgcccttcgaccgtggtggcgaggacgtgcagcagcttgcgctgacgagggctgcgcggcagcgggatccggtcgagggcgtcggcggccttcactccgccgcgtaccagctggatcaacgcgggcagcgccacgtcggcggtgtgcgccgtgtccgtttcgagagcggccagcgaggccttgagccgttcggt

SEQ ID NO: 4048 - DNA, 4993 bp, Unknown
  Kingdom: Bacteria, Phylum: Actinobacteria, Class: Actinobacteria, Order: Streptomycetales, Family: Streptomycetaceae, Genus: Streptomyces
gctgggtgggggtctggcgtccggcgggccgtcggctgcaccagttcgcggccccgctgggctgggctccgggggccgggtactggagccgggacggggtgctgcgtctcccgtacacgaacggtgagacatcctgcggcgtggcgatgctggacgcgccgcaggacgtggaaccctcttccgtgaccggccgttcgagtgacgcggagggcggaacgcgaccgtccgccgtcgtctccgctcctgctgtgtgtaagcccgttccgttggggcaggcgcctctgcaccgagccgctcgatctgattaaaatcgggatcctgggctacgcggccgtatcgggcgggtaccgacggtgaccacgtcggatggcggcggggcttgcggcacacgtaggcgcgacacaggtaagcgatcacaacggggtgacttcccacatgtccgaagcacggatcgacacgaaccagcagcgcccgacgggggcggacgagggggccggaaccggcggttccggaaagcaccgagggggtgcgtcggcggagaacacgtcggtgcagccgcacggtcgccaccgccggcccgccgatgaggaatccagggcggcctgagggccgcgcggcaggtgcgttctcagcacgaaggagggcccggaccggcggacagccggccgggcccttccgcgtgcgaccctccccctgctaccgccgcttcagtccgaggacttcggtggcggcgaaggtctcgttcggcggccggcccgcgtagtacggggtgagcagaccgtccagctccgcgaaggtgaaggtctccttcaccgcgtcgaaccgcgcggccacccggggccgttcgacgacggcgaccatgccgccgtggacgacgagcagttggccgttgaccccggccgccgccggtgaggcgagatagccgacgagcggggacacgtgctcgggcgccagggggtcgagggttccgtccgccggttcctggaagcccgcgaacacgtcctcggtcatccgggtccgggcacgcgggcagatggcgttggcggtgacgccgtacttggcgagggcgagcgcggtggaggtggtgaggccgacgatgccgcccttggccgccgcgtagttgggctggcccgccgatcccgcgaggaacgcctccgacgaggtgttgacgatccgcccgtagaccggtccgccggtctccttggagcgggcgcgccagtgggcggcggcgaagtgcgtggtgttgaagtggcccttgaggtggacgcggacgaccgagtcccattcctcctcggtcatcgagaagaccatccggtcgcgcaggatgcccgcgttgttgaccaggatgtcgagcctgccgtaggtggtgacggccacgtcgaccagcgcgcgggcctgttcgtggtcggagacgtcgccgaggtgggcgacggcctgtccgccggccgcgcggatctcggcggcgacctcctcggcgggggcggactcgaactggcccgcctcgtcgcggccgggctgcccgtagtcgttgacgacgacggccgcgccgaggcgggccagttcgagtgcttcggcccggccgagaccgcggcccgcaccggtgacgatcgcggacagtccgtccagcgggaggggaagggacatcggattcctcaacgtcggtggtcgggtgccgggttcacagctcgatgcaggtacgcagcgactcacccgtacgcatctggtccagggcgtcgttgatcccgtccagccggacccggtgggtgatcatcgactccaggtcgatgcggcccgcccgccagagcgcgatggcccgttcgtaggagcgcaggacgtccccgccgccgtacatggagggcaggatgcgcttctcgtcgaagaacagctcgaacatgttgacctggaagttgtcgtccatggctccggccccgacgacgcacagggtgccgcctcggcgggtgttctcgtaggcggtgcgggcggtggcggacttgccgacgacctcgaagacgtagtcgaatccctcgccgccggtgatccgctgcttggcgtcggccagaccgtcgggggcgacggcctccgtcgcgccgaagcggagggcggcctcgcggcgggaggcgaccgggtcgacggcgatgatctgcgccgcgccctggacccgcgcgccctggatcgtggagatgccgacaccgccgcagccgatcaccgcgaccgacgaaccggcttccaccttcgccgtgttgatggccgcgccgaggccggtggtgaccccgcagccgatcagggcagcgatctcgaacggtacgtcgtcggggatcggcaccgcgcagcccgcgccgacgacgacctcctcggtgaaggttccggtgcccgcgaagccgaagacgtcgccgccgggacgcttgaagttcggggtgcccgcgttcatgaaaccggccaggcacagctgggtctggccgcgcttgcaggacggacagtccccgcaggcgggcagccagcagacgaggacccggtcgccggcgttcagcccggtcaccccgtccccgacgtcgacgacctcgcccgcgccctcgtgtccggggatgaagggggcgggctgcgggaggacgccgctcatcgcggagacgtcggagtggcagagaccggtggcgcggatgcggagcttgacctttccggggccgaagcccaccgcctcgacgtcgtcgaggacttcgagcttctcctggcctatctcgtgcagtacggctgcgcgcatgggtacggctcccctcacatcgtcatctacatcagggttctgctgtgctcaggagtgttcgacgagcgtgtcggcgaggaccggcgcgtcgtcccgctcggcggcggcgaccgtcacctggacgcggccgtccccggtccacatccggatacggagggtctcgccggggaagaccactccggcgaaacgggtgcggtaggcggtgatccgggagacgtcgccgtccagcagggtgtcggcgacggccttcagcgtcatgccgtacgtgcacagcccgtgcaggatcggccggtcgaagccggccagcttcgcgaaggcggggtcggcgtggagcgggttccagtcccccgagagccggtagagcagcgcctggtcctcgcggacggcccgctcggccgtgcggtcgggagcccgctccggcggggcgagccggtcggagggaccgcgttcgccgccgaagccgccctccccccggacgaagatctgggcgtcgttggtccacagcggcccgtcgccgtcgctcgcctcggtacgcagcacgatgacggcggccttgcccttgtcgtacaccgccgcgaccttcgaggtctgcacggcgctgccggtcaccgggatcgggcggtggacgcgcaacgactgtccgccgtgcaggaccgcggcgaggtccacgtcgatgccctgcgcccccataccgccgaaggcggccgtgcccgcgcccgcgacggtggcgaagctcggcagcacctggagccgggactccagggtgtagcgcagttcgtcggggtcggtggcggggctgcccgcgccgagacccaggtgatagagctgaacgtccttgtggccccagccgatctcggctcggcggggttcggcggcgagtgccgcccgggcatcaatgggcatgacggagcagctccttgatggtccttggggtgggaagacctcggcacggccgtccgcaccgtcggccgcaccgaggtcgtgcggtgaccggcagggcacgccccttctagaacgcgttctagccgatggcccatgtataacgcaggccacggaagttgggaagactgctgacgttgcgtcagatcaatgcggtgagcccggtatcacccgggggtcggggcctcgaccgggaggtccgccggcgggcggggcctgcgatggttcggcagccagatcagcatcacgaccaccccggccagcaggaccccggtcgccgtgcggaaggccatcgcgtatccggcggtgacctcggccgcgtcgccggaacccgcggtgcgcgcggcggcgaccgtggagagcaccgagaggcccagcgcgccgcccatcgtgcgggaggtgttgaccaggccggagacgagtccggcgtcccccggatccgcgccggaggtggcgagggtggcgagcggggtggaggcgagaccggccccggccatcatcaggacgccgggcagacagatcgcggtgaggtaggaaccctccacacccatcgtggactgccagccgaagccggcggcggtgatcaggaccccggcgacggcgaggctcttcgctccggcgcgcaccatgaggcggggggccagcttggatccgatgatgacggcggccgaggtcggcatcagcgcgagaccggcctgcaacggcgtgtagtccaggacgttctgggcgtacacggtcatgaagtaccacatggagaaggtcgccgaccccatgagcatcatcgacacgttggccgaggacacggcccgtacggagaacacgcgcagcgggatcagcgggacggcggtccgcgcctcgaccagcacgaaggcggccagcagcacgactccggagagcagcggcacgagagtggcggcggccgcccacccctcggcctcggtctggacgatgccgtacgcgacggcggcgaggcccgcggtgacgaggaccgcgcccaggaagtcgatgcggcggcggtcgcccgcgcggccctcggtgatccgcagggcggcggcggccaggacgagtgcaccgatgggcacgttgatcaggaggacccagcgccaggagagggcgtcggtgagggccccgccgatgagcccgccggccgcgccgccacccgcgccgaccgccatccaggtgccgatcgccttcgtccgggcaggcccctcgggcacggccgcggtgagaatggtgagggtggcgggagccaggacggcggccccgaggccttgcgcggcgcgggcggcgaggagctgc

SEQ ID NO: 4049 - DNA, 1229 bp, Unknown
  Kingdom: Bacteria, Phylum: Actinobacteria, Class: Actinobacteria, Order: Streptomycetales, Family: Streptomycetaceae, Genus: Streptomyces
gccgaggtcggcggggtggacggttcgccggagccgccgccgtcggaacctgtcgtgccgccggagccggagccgccctcgccgttcaggacgaggaacgcggtgttgttggccggcttcgggtcgaacggcagcgccgggttctgcggccgggtgccgcggacggtcacttcgccgctcgcgccgatcagggccttgtcgatccgcagctcgaaggtcaggtcgaggcccgcgcggtcccgcacggtcatcgaggtgtcgcagacgtagcgcggcgcgggactgttctggtcctcgcggtacttcccgtcggcggtcaccgcacggcagcggtccggcttcgcgctgaccgacgcgccctgcgggacggtgaagtcgacggtggcgacgtcctcgccggagcggatgtggccgatccaggcgggaccctcgttgcggaagccgatatcggccctcaccgtggtcccggcggctccggacgcctcgtcgccgtacgccacgaagtcggccgtgttcttcgtacggaagtcggcctcctgctggttgtcctccgggttgaggtccccgccccgggcggccgcgccctgctgggaagcctccgccgggaccgccttcagcacgggtcccgcgccccgcacgaagggagcgtccgcacgctcggcggtgcgctgggcggcgtcgtcctcgtggatgcggtagacgaaggtgtcgtagtaggcgcgggtggtggcctcgatggtcagcggggtcgccagcgtgtacgtctcgcccgcctcgaaggcgccctcgacggagcagagggccgtggtccagccgatgcccgggacgtccgggtcgtccacggtgtactcgcagttggcgtagcgctgcggaatgtcgagaccgcgggagtacatgagggtgagcagaacgccgtcggcgtcccggctgccccggttggtgaaggtgatcggagcctgctgctcgtcgcccgggttcagctcctggtcgaaggggagccggtgcatgaccaggtcggggccgccgaccgtgagccgggtggtgaacggggtgaaggtcgccccctccgcctcgccggtcaccctgatcgtgcccgtgtccccggcctcgctgccctcggcggcggtgaccaggaggtcggcggcgcgctgactgcccggccggacaccccggtcctggcagaccgccttcgtgccggtcacctcgcagtcggcgccgccggactcgcc

SEQ ID NO: 4050 - DNA, 1900 bp, Unknown
  Kingdom: Bacteria, Phylum: Actinobacteria, Class: Actinobacteria, Order: Streptomycetales, Family: Streptomycetaceae, Genus: Streptomyces
catctacgccgccggggatgtcgccgccgccgcccacccgctgctcggcgcccggctgcgcgtcgagcactgggcgaacgccctgaacggcggaccggccgccgcccgcgccatgctcggccaggacgtgagttacgaccgcgtcccgtacttcttctccgaccagtacgacctgggcctcgaatactccggctgggccccgcccggctcctacgacgaggtgatcatccggggtgacgccgggaagcgggagttcatcgcgttctggctgaaggaccgccgcgtcctcgccgggatgaacgtcaacgtgtgggatgtcaccgagacgatccaggagctcgtccgcgcccgccagcagcacgacccggaagccctcgccgacccgtcggtcccgctggactccctgctctgaggaccctcgccggtgcgcggccgggcaccgcccgcgcaccggcgaggctcctgccgcgcgtccgactgtccgcgcccacccgtagacttcacccgtggctggcaggatcaatgacgacgacgtgaaggcggtacgggacgcggtcccgatcgactccgtcgtgtccgaatacctccagctgcgcaacgcgggcggcggaaacctcaagggactctgccccttccacgacgagaagtccccctccttccaggtcagtcccggcaagggcctgttccactgcttcggctgccaggagggcggcgacacgatcgccttcgtgatgaagatcgaccacctctccttctcggagacggtcgagcgcctcgccgccaaggcgggcatcaccctgcgctacgaggagggcggctacaacccctcccaccagcgcggcgaacgcatccggctgatcgaggcccaccaggcggccgccgagttctacgtccgcgcactggagagtcccgaggccgagatcggccggaagttcctcgccgagcgcggcttcgaccaggacgccgccagccacttccgcgtcggctacagcccggccggctgggaccacctcacccgctatctgcgcggcaagggcttcagcgacaaggaactgatcacctccggcctctcccaggacggccgccgcggccccatcgaccgcttccgcggccggctgatgtggcccatcagcgacaccgccggggagatcgtcggcttcggcgcccgcaagctgcgcgacgacgacaacggcccgaagtacctcaacacccccgagaccccgatctacaagaagtcccaggtgctgtacggcatcgacctggccaagaaggacatcgccaaggccagccgcgccgtcgtcgtcgagggctacaccgacgtcatggcctgccacctcgccggggtcaccaccgccatcgccacctgtggcaccgccttcggcaacgaccacatcaagatcctgcgccgcctcctcatggacaacggcagcgcccgcgtgatcttcaccttcgacggcgactcggccggccagaaggccgccctgcgcgccttcgaggacgaccagaagttcgccgccgagacgtacatcgccattgccccggacggcatggacccctgcgacctgcggctcgccaagggtgacgactccgtacgcgacctggtcgagccgcgcaccccgctcttcgagttcgccctgcgccagatcgtcgcccggtacgacctggagaccccggccggccgcgccgccgccctcgacgaggccgccgccgtcgtcgccaagatcaagacgagcagcgtgcagcgcgaggtcgccgtccagctcgccgggctcgtcggcatcctcgaccaggagttcgtcgtccaccgcgtcgcccagctcgcccgctgggcccgggacaagggcggcgaccacggggaacgcggcggtcggcgcggcgcccccgagggcccgcgccgacc

SEQ ID NO: 4051 - DNA, 1860 bp, Unknown
  Kingdom: Bacteria, Phylum: Actinobacteria, Class: Actinobacteria, Order: Streptomycetales, Family: Streptomycetaceae, Genus: Streptomyces
ctgcgggtagccgtacgccggggtgcccggcgggggcgtctgcggcgggcctgccggagccgtcggctggccgggcggcgtctgcggcggcatggccgggttcggccggccctggggctgctgaggagctccgttcggcggctcctgcggagcaccgaagcccccctgcggcggttgctggctgggcggctggctcatatcagcacgtcccccttcgtgcggcccggtgcgcgaatcggtctcccccgcattcccaagagggttgattcccctcggaaaggagcgaatcgggcatggcttccgcggtgttacgacagtcgggcggggcttctttgtaccacccgtccaccaccggacaccggttcgggccaacccctgttcccaagggagaaccgccttgtgatgcctccgttacgccccgcgggaggtgatggtcagtcaccgaaggcgatcatcgtccgcaggtccatctcctcctcgtcggtctccgcggtgatgtagccggaggtgatcaaggagcgtccgccgacgaagcggatcgtaggatcgaacaggccgaccaccgccttcgccgccgacgccgggtgtcgcaggaccggccggagagcgccgccctgcggcccgagcgccatgatgccgccaccgttcctggccttcgcggacggcggagtcaggtagagcagcacctggccgttctcgacccgcatcggatgcagcgtctgcgcgggcggcgccggaaccttccacttggccttgccggtgctcatgtcgaaggccacgacggagttggtgagctccctgtccgcgccggcggcgggcttcgtggcgaggtagagcgtgtcggcgtcggcggccgctccgacgcagtcgtcgaggttctcgccctgttcaccgcacaggacctcgaagttctccttgccggggacgggctgggcccggtaggtgccgtcggggttcaggagcgcgatggcccacttctcgttcaactctccctgccgcagggagacgaccggcggatcgaccgagtagaaccggtcgaccttccaccccttcttgaccttgtagctccacaccgtcctgccggtggccggatcgatgcgccgcacctcctcgtcggccacgtcgtcgtcgctcggtcgcttccggcagtcgaccgcggcgagcgcgacgtcgccgctggtgaggccgtacggctggcaggtgccgggcagcgtgccccacaggtgctttccgtcgctgatccggtaggcgtcggtgagggtggtccgcccgaccgtcacgacgtcgccgttgatcgccatgacgatgtccgagagcccgtcctgcatccccgaccggtcgaccgtcgccgtccagcccgctttgccggtggtcaggtcgatcatctggagcttctcgcagggcgcaccgtcgccggtgtcggtcctgaccccgatgacgaccttcccgtccgggctcggcagcgtgggcgcggcgcagacgtcggccggcaggcgcagactccacttccgcgttccgtcctcggcggaatagccggacgcggtgcggtacatggccttggccacgaggtcgcccgtgaaccacgggccgcgcacgtgggcgcctccctgcggcaggtccacgccgttcttctccacccagcggaccttcgcctcgccgtccttgcggcccttgttgagctccgcggcgcccgcggccggcgtcaccccggggccgggtttctccgaggccgcgctctgcttcgcggcgggcttcccgtcgtcggtgccgtcgccgccgaccgcgaaccagacgcccgccccgatgacgaggaccccggcgagcacggccgcgacgagaccggcgacccggccccgggag

SEQ ID NO: 4052 - DNA, 1987 bp, Unknown
  Kingdom: Bacteria, Phylum: Actinobacteria, Class: Actinobacteria, Order: Streptomycetales, Family: Streptomycetaceae, Genus: Streptomyces
gcgagccgcagctcctcggggagcgtggcgaaccagcggcggtagtcggcggccgggatacggaccgggttgcgggccaactgctcctcggtcagccactcctggtcgtggccgcccgcttcgatcagcgcgtagatcagctcgtcgccgtcgccggagaccagcccggggatgtcctcctcgggcccgaagtcgtacccctcggcgcgcagccgccgcagcagcgcgacggcgctggcgggggtgtcgaggccgacggcgttcccgatccgggagtgcttggtcgggtaggcggagagcacgagcgcgacgcgcttctccgcgttcgggatgttccgcagcttcgcgtgccgtacggcgatcccggcgacccgggccgcgcgctcggcgtcggcgacgtacgccgggagcccgtcctcgtcgatctccttgaaggagaacggcacggtgatcagccggccgtcgaactccggcaccgcgatctgggtggccgcgtccagcggggagacaccctcgtcgttctcctcccaggcgctgcgcgggctggtgaggcagagggcctggaggatcggcacgtcgagcccggtgagcgcgcccgcgtcccacgactcgtcgtcaccgcctgccgacgcctcggcgggcctggtgccgccggccgcgaggacggtggtcacgatggcgtcggcggcgcggagcgcgtcgatcagctcgctctccggcgtgcgcagggacgccacgtacagcgggagcggccgggcgccggcgtcctccacggcggtgcacagcgcgtcgatgaacgcggtgttcccgctcatgtggtgggcgcggtagtagaggacggcgaccgtcggcgcaccctcggccacctcgcgggcctcccgctccagcggaccccacgcgggggccggagcgggcggctcgaagccgtggccggtcagcagcacggtgtcggagaggaaccgggcgagctgctccaggttggcgggcccgccgtgcgcgaggtaggcgtgcgcctcggcggcgatgccgatcggcacggtggaggcggccatcaactgggcgtcgggggcctgctcaccggtcagcacgacgaccgggcggccggtggccagcaccgcgtccagtccctcctgccaggcccgaaccccgccgaggagacgcacgacgacgaggtcgacgccgtccaggaggtccggcagtccgtcgagggagacgcgggaggggttggcgtaccggtagctgacgggtccctcggaagcgcgggcgctcaggaggtcggtgtcggacgtcgacaggagcaggatcatgctgcgtcaggccttcctcggggtgtccacgccccgggcggtgtcggagggtctccccacgtccggctcggaaaccgggcgctcggggaagggagttcctgactcgcccggccggtggtggcggccgtgctcacagtggcgggaccgcgccggaatctcaccgggcttcctcccctgtcgccgtctggcgatggcggcctgaacggaccaccgcctgcatcctaagcggcggggggtcgatcggggcggggggcgggggtgcgggggtgatcacggttcgcgcggcggggcggctctccgtaccgcccgcccccgggcctggcaccccgctgtcccgcaggtcacaggagcgggcccgtctacgggaccggcccggtcggtatgctcgccgccatgcccggttccgccccctcgcccctttccgcgggcggcacatccccccgcgacggcggcgacgcctgcccggggacgctgcggctgcaccgggccgacgacggtgcgctggctcgggtgcgcatccccggcggggtgctgagcgcggaccgggcggacgcgctgctcgcggtggccggccggttcggggacggtgagctgcatctcacctcgcggggcaacgtccagctgcgcggcctggacgcggagtgcggcggcgggccggccgaactgctcggcgccgccgg

SEQ ID NO: 4053 - DNA, 2957 bp, Unknown
  Kingdom: Bacteria, Phylum: Actinobacteria, Class: Actinobacteria, Order: Streptomycetales, Family: Streptomycetaceae, Genus: Streptomyces
gagcaggccgagcaccaggtgggccgggaggatctcggcgtgccgggcggcctgggcctcgttgtgggcggccatgacgacgttgcgggcgcgctgggtgaagcggccgaagccctgactcgggtccaggtcggaggcgccgtcgcccttcttgggcacgaagcgcttctgggccgcctgccgggtgacccccatgctccggccgatgtccgtccaggaggcgccggagcggcgtgcctggtccacgaagtggccgatcagatggtcggccacgtcgccgaggtggtcggcggcgatgaccgcgccggagagctgctccagggcgtcggtgttggacttcttgatggcctcgatcaggtcgtcgaggcgcacggagggtgtggcgggaagaggctgcgtcatgcgtcaaccgtaggttgacacccacatggtgtcaaccttgagttgtcagtacgacgtggcctccgctcccgtggatcctggctcagaggtcgaggtcgacgaccaccggcgcgtggtccgacgcacccttgcccttgcgctcctcgcggtcgacgtagctgtccttgactgcggcggtgaacggggcgttgccgaaggtgaggtcgatccgcatgcccttgttcttggggaacctcagctcgcggtagtcccagaaggtgtaggcgcggtcgtacttgagggggcggggcagaacctcgctcagcccctccgtctccagagccgcgagcgcggcgcgctcggcgggcgtcacatgcgtggcgccgacgaacagcgtcgggtcccagacatcctcgtcggtcggggccacattgaagtcgccgaggaccgcgaacggcagggccttcgccgcgtccgccgccacggccttccgcagagcctccaaccagcgcagcttgtacgcgtagtgctcgtgctcgacctcgcggccgttgggcacgtacaccgaccagaggcgcagcggaccgcacgtcgccgagatcgcgcgcggctcctgaaccccgtcgtagtccgggccgtcgggcagcccggtgacgacgtcggagaggccgacgcgggagagcagcgcgaccccgttccaccggccggtggcgttgaccgcggactcataacccagctcggcgagcgcggcggtggggaactgctccgccgtgcacttggtctcctggacgcacagcacatcggtgccgctgctctccagccaggccaggagcctcggcagccgggcggtgatcgaattgacgttataggtggcgatgcgcatggcagccaacctagcggctcccactgacagtcgccggagggctcacagctcggtgacgccgcccggggccagccggccgtggtcggcgccgcccagggacccgatctggctgtcgtagatcggccgcgccagatcggtcagcagggcgtcgtggacgtcgatggcgcgccgcggctcgacctcgcgcacatagtcgatgacctcggagatcttgctccagggggccatcaccggcagcagcagcgtgtccacgggacgctcgggaacggtgagcgcgtcgccggggtggaagaccgaaccgtcgaccaggaaaccgacgttggtgatcctcgggatgtccgggtggatcaccgcgtgcagctcgccgtgcacggtgacgtcgaatccggcggcggagaacgcgtccccgtcgcccacggtgtgcacgcgcccggggaaggccgccgagagctgctcggccacgctgcgcagcgtccagatctcggccgccgggttcgcctccaggcccacccgcagccgcgcctcgttgaagtggtccgggtgttcgtgcgtcaccaggatgacgtcggcgccgagcgccgcgtcgtcctcggagaagccaccggggtcgatgaccaggacccgcccctccttcgcgatcctgacgcaggagtgggtcttcttggtgagggtgagtgccccgggcgatgcgttcatgactccatcctgctacgcgggcggcgtggtttcctcctggatcaccgtctgcgcgacggcgaaggcggcaccggcggccgggagtccgcagtagacggcggtctggagcagaacttccttgatctcggcgggtgtcaggccgttgcgcagggcggcacgggtgtgcgcggccaggccctccagatggccggaggcgacgagcgcggtgagcgtgatgcagctgcgggtgcggcggtcgaggccgtcccggctccagacctcgccccaggcgtaccgggtgaccagctcctggaagtcctcggtgaatccgtcggccgaggcgttcaccgcgtcgacatgggcgtcccccagcacctcgcggcgcaccttcgtgccctgctcgtgccggtcgtccggtgtcggagcggaggtctcgggcgtcgcggcggccggggcgatctcggccaccggggcgaatggagcagcgggcgtcgcgggcccggggacgagcggcagcacggggatggccgccgacgtgtcctgctgccaggcggtggagaagtgcatcagcagcaggtcgctgacggctgcgggctgttcgaccggcgcgaggtgcgaggccccgggaacgagcgccaggcgggcgtccggtatcccggcgaccagcgtgcgggcctcggcgggcccggtgacctggtcctccgccccgaccagcaccagcgtgggcacgccgatccggcccagggcgccgcggatgtcgaacgccgcgagcgcctcgcaggcggcgatgtagcacccgggatcggtggtgcggaccatctgcacggcccattcgacgatggcgggctgcgcggcggcgaagccgggggtgaaccagcgctccggcgcggtgcgggccatcggctccagaccgttggtgcggacgatcacgccgcgctgacggaactcgtcggccgtgccgaaccggggcgaggaggcgacgagcgccagcgaggcgacccggttcggcacggccgac

SEQ ID NO: 4054 - DNA, 2432 bp, Unknown
  Kingdom: Bacteria, Phylum: Actinobacteria, Class: Actinobacteria, Order: Streptomycetales, Family: Streptomycetaceae, Genus: Streptomyces
aacccgaccggcgcgggcgatccggaccagttcggcgtaggccccgacatggatgccgggaggcaggctgccgcagagcgcgacggcctcggctccggcgaccagctcctcgtacgtccgcaggaagacggcccattcggcggggctcacctgcggtccgggttcgttgagctgggtggtgtcgccggtcgagcggtcggtgaccgccagggtgcggcgggtgttcccggcgacgggcacgagggcgtcacgcggcgggagcggggcgagcagggagcgcaggacgtccccggtcgggcctccggcgaagccggtgacgacgcagtcgtggcccagtgcgccgaggacccgggcgacgttgaggcccttgccgccggggcgctcggtgacctcgccgacccggtggctgctgtgcgggacgagcgcgtcgacggtgtacgtcacgtcgagcgcggtgttcagagtgacggtcaggatcacctctgccggtccctccctcggtgcagggccctggggcctctcgttcggatcatgtcgggctcgcggggtccggcgcgcgcacccgtccgccgggcgccgatctgatgatcatgtcaaagcgatggcggtcggcccagtcccgcgggccgaccgccatcgcttcgttacgtgctcccgaccgtcggccgcccgcctaggcggtcttcggctcgatgatccactcgccccggcgcatgacgcccttgaggacgaagtcctcgtcgaggacgaccaggtcggcgtccttgcccgcctccagcgagccgacccggtcgtagacgccgagcagccgggcggggttggcggagatggaccggacgacgtcctcgacggggatgccgtcgagggtgacggcccgccggaacgcggtgtccagggtgagcgtggagccggcgatcgagccgccctccaccagtcgggccaccccgtcggtgacctcgaccgcgagcgggccgagctggtactccccgtcgccgaagccggcggcgtccatcgcgtcggtgatcagcgcgacgcggcccgcgcccttgtggcggtaggccagctccaggacggccgggtgcagatgcgtgccgtcgttgatcagctcgacggtgatccggtcgtcctccaggagggcggcgatcgggccgggatcgcggtgggcgagcggcggcatcgcgttgaacaggtgcgtggcgacggtcgcgcccgcgtcgatggcctcgacggtctgctcgtacgtcgcgtccgtgtggccgatcgcggcgatgaccccgtgctcggcgagcagccgtacggagtcgatgccgcccggcagctcggtggcgagggtgaacatccgggcggtgccgcgcgcggcgtccagcagcttgcggacgtcggccgggtccgggtcgcgaagcagctcctcgctgtgggcgcccttgcggcacggcgagatgaagggtccctcgaagtggatcccggccaggtcgccctgctcgaccagctcggacaggacgcccgcgcgccgggcgaggaagtccatctcgccggtgaccgtggaggcggccatcgtggtggtgccgtgctcgcggtgcgtacggatgccggtgaggacctcgtcgacggtgccggaggtgaaggaggccccgccgccgccgtggttgtgcatgtccacgaagccggggaccacccagtggccggcgaggtcgatggtccgggcgccctccggtgcggaaccggagatccgggagccctcgacggtcacccggccgtcctcgacggtgccggtggggagcaccacccgggcgccggcgagaacggtgctgtctgctgcgcgtccggccatcaggcggaaacctccgtggagagtagatcccaggcgagcagccccgcgcccaggcatccggcggtgtccccgagggccgccgggacgatgtggggcagtttctggaacgtgatgcgttcctcgacggccgcacgcagtggtgtgaacaaggtttccccggcttcggcgagaccgccaccgatgatgagcgtgccggggtcgagcagggtgagcgcggtgacgaggccggcggcgagcgcgtcgaccgcgtcctgccagacccggaccgccgcggggtcgcccgactcgacggccttcgcgcagtccgcggcggccgaggccagcgtctccaggcagccgcgctggccgcagctgcagtcggggccgtccgggcggaccacgatgtggccgatctcgcccgcgtccccgtgggcgcccgcctcgatggcgcccgcgatgccgatggccccggcgattccggtgcccagcgggacgaacaggaagcggtccgacccacgcccggccccgatcctgccctcggcgagcccgccggtgcggacgtcgtggccgagggcgacggggacgccgaggcgctcgcccagcagggcgcgcagcggtacgt

SEQ ID NO: 4055 - DNA, 599 bp, Unknown
  Kingdom: Bacteria, Phylum: Actinobacteria, Class: Actinobacteria, Order: Streptomycetales, Family: Streptomycetaceae, Genus: Streptomyces
gcctacctcggcggctccgggatcgccgcctgtctgcgggccggggccgatgtcgtcgtcaccggccgggtcaccgacgcggccctggtcaccgggcccgccgccgcccacttcggctggggtccggacgacctggacgcgctcgcgggggccgtcgtcgccgggcacgtcctggagtgcggtacgcaggcgaccggcgggaactacgcgttcttcggcgagcacgacgcccgcctcctttgccgccccggcttcccgctcgccgagatccacgccgacggctcctcggtgatcaccaagcacgacggaacgggcgggttcgtcgacgtcggcaccgtcaccgcccaactcctgtacgagaccggcggacccagatacgcgggtcccgacgtcaccgcccgcctcgacaccgtgacgctgaccccggacggcccggaccgggtccgtatcgacggcgtacgcggggaggccccgccgcccacgctcaaggccgggctcacccggctcggcggctggcgcaacgaggtcgtcttcgtcctcaccggcctggacatcgaggccaaggcggaactcgtgaaagaccagttcgccgacgccct

SEQ ID NO: 4056 - DNA, 3416 bp, Unknown
  Kingdom: Bacteria, Phylum: Actinobacteria, Class: Actinobacteria, Order: Streptomycetales, Family: Streptomycetaceae, Genus: Streptomyces
tcggccgccacgacctgctcgacgggcgcggacccgggggcgtgcggaaacgtggtgcgcagtccttcgtggcgcagggccagcgtgcgcagggcgtccacgatctcgtccgggcccacgcccggggggatggcccacacgtcgtggttgttgatgtgctcggggtcgtcccgcaggatgcagcggatcatgttggcctggcccatggtgagggggcctcggcgttcgtcaccgcccgcgtaggcgacggtgacggcacgcggggcgggcgtggtacggggggcgtcgtccaggtacatggtgtccttgccggctgcggagttcatcggatcccggccaggcctgcttcggcgctcgcacgagtcaacgcctcccagtggtccatcaggagtgcgaagtcggccatgtcgtcgcgggcctcgtccaggagccgggagcggcgttcgaccaggatgtcggcgaccgtcctgtagcggtcgccgagccgccggtaggcgtcgtcgaggacgtccaggcggtgggcgctcaccgcccggtcgaggccggtgctgtcccggacgaacccggcgatctcacccgcccggatgcggccttcgtcgtcgagcagcgcgtcacccgccgccgccgtcctcgcgtacacggcgttcagatacgccttggacagcaggaacttcacgaagcgcagctggtacgcgacgaacccgtcgtccgtacgccgttccgccgtatggaagttgacgatgtgccggttgtgctggacaccgggcattttggcgtcgtggaggaggtggatcaggaagtagtcgctgccgatggtgtcggtggcgggcggcagcgggactctgcggtagacctcgtggtcgagcgcgatgttgcacatgtccacgcgcatcgggctgatgggggcgagcgtggtgcggtcgccgtcgaacgcggtgtccccggcgccccggaaggactcgtcgatcagatgtccgcgccagatctccgggtatccgtcgggtatcgacaggccgatcagttcgcggtacgtgtccgggtcgaggtcacggatctccgcgacgtccaccgacatctctcccacgaaggagccgccggtcatcgtcacccgacggcccccggcccccggcggcagcttgctccgggtcgccgactcgcgtacgtcgtccgcgcgttgacctaggtaggtcaactcctggtggagcgggaagaccggttcgccgtcgaggtgctggtagcggctgtcggagtcccggcggtggacggacgtgcagccgagggcctgggcgatgaggaacgcccggttggtgcaggcgccgtaggagacgcgggacggcagcatcagttccagcagccggtcgggcggagcgccgccggaccggccgatcgcctcgcgcaggaaggcgcgttgctcgtcctcgtcgaggtggtggacggtcaccccgggggacgggggaagcgcggcaaccgacctccggtgctcggcgagcaccggcgcgggggaggagtccaggatcaggaggtgcacctcgacgtcgaaccgccgtgcgccgtacgccgcttccgcgccgatcgccgcgatggtgccggtgcagacccggtgggtgggcagggtcagacagacgcggcgcacgaaggctccccgctctgcgcggcgggtgcggtgtcctcgaccgggtcctgccacgaggcgagccccagcagccggctgcccagcgggttcagctcggccgtgggatagcgctgggactcgggccgtaccgggtcgccgaccagggtgcggttccagcgcggggtgcgcaggtggcgccaggactccacgcgggacttgcgcagccgctcgtgctcctccagcgcgggcatcatcgacaggtactgcacggcccgcaccccgctctcggagaggttgcgcgccactccgtgggcgagcaggccgttccagatgagcaggtcgccggggtgaagatccggtcgtacgacggggagttcgttccggtcgatggtggggcgcagggggtcccggtccccgggctggccggtcttccaggtgtcgaactgccggaacagctccgggcagcactggaagccgcccgtctccggccgggtgtcgttgagggcgatgatgccctgcacccgctgcggcgggacggcgagcgtggtgtcgatgtcccagtggagctcgatgtcgaagccccggtccgtcggctcgatcagggcgcggtcacggttgccccggttgggcgggttgaggttgagccggtccagggtgacccacagctcctcgcagtcccatacgtcgacgaaggcgtcgtacacccgctgcgactgccggttgtcccagaggagctggtggtggtacgcctccacgaagccgtagatgtgcagttgctggtccagctcggagcgcagcggccgctcctcgtaccagctctccggccgttcggggtccaggccctggaagtcccaggtgaagtccagcagttgacgtgccaccgaggccgggaccgcttcccggacgatgacgtagccgtacgtctgccagtgggcgaagtcctcctcggagagcacgcgcagcggacgcgacttgtcgagctcccgaagggcggtctgcgcgaggtaggcctcgccgtccgcgctgaagtacgggatgtccgacgccgcgcggtgcaggcggggccgacggcgaggggcgggtgtcgtcatgaggttgatggcaggtccttctcctcggccggccgcgcggcgaccccgggggagcggggtcgccgcggacggcgggacggatggcggtgccgtggcgggaggagccgtgaccacgtcggtcagcaggattggtccagaccgcccgggctgtcaagtgtctgccacatatggggatatgggatgccgtcctgcgctcggcggccacggaatcgatacctgccgttcggtatttttggtctagacaacaggtgagcgacaggcctagtgtccgagggcgcggtcgggttcgtgacgggtcgtcattcctgttgccagcccgtactccggtcggttacggccctgttcggggccgccgacgccacggcgatgtggtccgtacgtccgaggggcgtgccgattgccggcccacaccgagaaagacgcggtttcatgaacacatccagcatcacggccctgccgggtatcacgctgaagagtcccggtgccgggctgatcacgctggacccggcccgcaccgcactgctgaggggactggacgatctgctgagcggcctcgccgcgcggctcgccgcccccgaggtcgtggggccgcccctgctgtccgtcgacggactggcgcggctcgacttcttccgcaattttccccatctcggcgtgtccgccgggcggttcggcccggatacgctcgacggtctggcctccggcggctcgcc

SEQ ID NO: 4057 - DNA, 2073 bp, Unknown
  Kingdom: Bacteria, Phylum: Actinobacteria, Class: Actinobacteria, Order: Streptomycetales, Family: Streptomycetaceae, Genus: Streptomyces
gtgattccggtgcgctcggctggcggccgaccggctggcggccaccgccgagcgcaccggaatcacgcgcttcgccctcctggtggaggggtcgggtgatctcgcggcgaccgaggagaacgtccggcggctgggatccgacgtgctgccgctgctcacctgacctgcgcatgccggtgtttcctcggagacatctgacatcggtgggacatgtggtgcggtggtacaggagctgccgccccggagccagttgcacctcccgcggcccgggacggcagcagaagcgttcagcagtcccgtagttcgggcgactggttgagcaactggcccctcaccgaggtgaacttggccagccggtcgtcgaccgaggcgtccagcgggaacaccgcgacgcggtggcagttctggaatgcgatgcgcactccgaagtgccgctggagcgcgccgcgtatcgcatcactcgcgagcgcgcgcagcagctgaccacgtgcctgctcgtccggcggcggcgtctggttgtcggcgaactgtccgccgtcgaccttcagctgagccaccagcgagctgatcatctcccatgcgaagggcagggaggtccggacgcagtcgacgaagtcggcttcgtcgacctcgcctcgctcggcctgttccaacagcgccggtgagacgtcgagcgacatgggttctcctctcgcgaccccgggcacgtgccggggccttacgggcagggaagggggcggcgacgacgcagcgtgcacggacggcgacctcctgcttccacggtaagcgcgcagtcggggccgcaccaggagattgggaacacaaccggccaataacgaaggggcgcaaagaggggcaagcccgatcggtcgtgatgcggtgtgcaccgagtgacaggggacgacggatggggaaatcgcgtcgagcccccgtcgtcgagtagcgttgccgaccatgcgtctcgtcatcgcccgttgctccgtggactacgcgggccggctcacagcccacctgccctccgccccccgactgatcctggtgaaggcggacggaagcgtctccatccacgccgacgaccgggcgtacaaaccgctcaactggatgtccccgccgtgcaccctgaaggagggcgccgacggtgaggaaggcgtctggaccgtggtgaacaaggcgggcgaaaaactgatcatcaccatggaggaagtcctccacgactcgtcgtacgaactgggcgtcgacccggggctcatcaaggacggcgtggaggcgcacctccaggagctgctcgcggaccggatcgagatcctcggcgagggtcacaccctgatccgccgcgagtaccccaccgcgatcgggccggtggacatcctgtgccgggacgcgaacgggcagacggtggccgtggagctgaagcggcgcggtgacatcgacggtgtcgagcagctgacgcgctatctggagctgctgaaccgcgacccgcacctcgcgccggtccggggcgtcttcgccgcgcaggagatcaagccgcaggcccgggtgctggcgacggaccgcggcatcggctgtctggtcctggactacgacgcgatgcggggcatcgaggacgacaagctgcggctgttctgagcgacggcacgcggctgttctgagcgacgacgtcaacggagggccgggcggctcacgcggaagcgtgagccgcccggccctcgtacgtccggccgcccgcagggttcagaccgccgggtcggtggccgcttcggactccggggcactcgccgactcgacggggccgctcgcggaggaggacccctggggcgggggcgggggctcgtcggtgggcgactcggtcggcgtttcgctctccgactcggacggtgtggggtccgggctctcgctctcgctctcgctcgccgtgggcttgggcgaggtcttcgtcggcgtcggctcgctcggcgaactgctcccgccgtccgtcgggtcgtccgtccccggcgacgtaccgcccgacgtggaggcgctcggggacggggagccggacgtgctcgggccggccgaacccgaggggccgggggt

SEQ ID NO: 4058 - DNA, 957 bp, Unknown
  Kingdom: Bacteria, Phylum: Actinobacteria, Class: Actinobacteria, Order: Streptomycetales, Family: Streptomycetaceae, Genus: Streptomyces
ccggggtcagagcccgcagggcgacccgggtcaccgtgcccttgctgcccaagccgcgctctgcctcgcggtcggcgatgtagttggcgtcgcgctcggccagctcctgcgggcggtgtgcctgcatcaccaggaccggcagttcaccgaggcgggcggtgaacgaggccagccaggcgagggattcgccgtccgcccagtgcgcgtcgtccacgatcagcagtaacggccggtggctgagccgggacgcgagccggccgacgacgaagtccaggccgtcgcgcacaccctgcgggtcgggctgcaggccgctcggctcggcgagtcccagagccggggcggtcgtctcgtaccagtcgccgaacagggcgcgggtctcgtcgggcgggaactgatcgagtgcgggctgcagcaactgccgtacgacgtggaacggtacggaggtgacggtctcgcctccccgggcggaccagacggtgcaacggtcggcggccatcctgcggatctccgcgagcagtgcggtcttgccgatccccgcctctccgctgaataccaggagtccgccgacggcctgcgcaccgcacagggcgtccaccgcctccgcagcggcggcgagttccggttcacgctcgtacaacggccgggacggcttcatgcccacccttcccacagaggcagtcttctcgacggtcgagcctagtcgtgcgcgggtgctcgccgacagggttcgcacgattctccgcaggtgcggggcacaatcgagtagtgaacgagacgcgcagagaccgtgatgccgagggccgggcgcgcaacgcgcgcccccgtgacgggctgggacgccccctgccgtacgggacacccggcgtcgaacgacagccggagggggtcgtccgcacgcctgcggagacgctccgggaagcgcagcggctgctggacgccgggatgccgttccacgcg

SEQ ID NO: 4059 - DNA, 2381 bp, Unknown
  Kingdom: Bacteria, Phylum: Actinobacteria, Class: Actinobacteria, Order: Streptomycetales, Family: Streptomycetaceae, Genus: Streptomyces
tgagagcctgtcgggtgacccctgtccgggcggccccgccctggcacgcacgcttccggcgttgccgaagcgccctggtagctccgctacgaggaccttccggcgcctgggaatcgcgcgcaccatgccgtgtccgctttccgatcggaggccacccgacaggctctgcgtccgccccgccgcggttgacgcggcgtcaccgggtggcctacccctactggatggcccaggcgcccggtcccggtgtcataccggagcagtaggcggagttgatcccccgggctgacgcttcaggccgtccgatttggtcagatggataccaacggaagccgccgaccacggaggtagggcacaccatggcaccgaacgacagcgcagagaccaccggcgaggccacgagcactgtcgtgggccgccggaaggcggcgcgctacatcgtccccgtcgcggtcgcgggcgtggcggccgcgaccatcgggctcgtcccggcgctcgccagcaccggcgacccggacctgccgaagatcagcgcacagcagctcatcgagaacatcgccgcttccgacgcggagcagctctccggcacgttcaagatcagcactgaccttggcctgcccctcgacggcctcgcgggctcgctcgtaccggacggcgcgggcaaggacggcggcgcggcggccccgcaggacaagctcatggagctgacgtccggaacgcacacgctgcgggtggccgccgacggcccggagcggcagaagctctccatcctcggggacgcgtccgagtacagcctcatccacaaccagggcgaggtctgggcgtacgacagcaagtccgacgaggtctaccacgccgaggctcccgagggccgggacggcggcgagctcgcggagaagagcccgaaggctcgcaagggcgcttcggccactccgaaggacttcgccgagcaggcgctcgcggcggccggggacaccacctcggtcaccgtggacggcacggcgcgggtcgccgggcgggacgcgtaccagctgctgatcaagccgaagcagtccggttcgaccatcggctcggtccgcatcgccgtggacgccgagaccggcgtaccgctgaagttcactctgtcggcggcgagcggcggcaaggccgtggtcgacgccgggttcaccaaggtcgacttctcccagcccgccgcgtccacgttcgccttcacgccgcccaagggcgccaaggtgaccgaggccgacgagctggagaccggcaaggacgagcacggcgcggtgcaggaggcgctccccggccagctcgccgagctggacggcttcgagggcttcaacgtcatcggcgagggctggacctcgatcgccgagatcaggacccctggcggcacgggcctcccgaaggccggctcgggtgagatgccggccgaggcgcagggcttcctcgacgcgctcggcgacaaggtcaccgggaagttcggttcgggcacggtcttcaagacgcgcctggtcaacgccctgatgacggacgacggctcggtgtacgtcggagcggtgacgaaggacgcgctggtccgcgccgccgacgccgccgccaagtagaacaccccggcgcccgccgtgccgggcgaccggcgccggacacccgccccgtcgcacaccgtgcggcggggcggcagcgccgcaggggtgctgccagccgcgcggacgggagaggtacgaccgggatgacgacgacggggacggacggggcgaccgagtcggctgggtcggctggggtgcgcgtggcgcgcgcgggagccgcgtcgggcggtgcggacgcttccagcacggcggacgccgcgagtgcgtcgggcggtgcggacgcggcgagtgcgacgggtccggcgggcgctgtgggtgcggaggagatcggtccggtcgtcattcgcacccgtggtctgaccaagcgctaccggggcggccagctcgccgtggacggcctcgacctgaccgtgcccggcggcagcgtcttcggcttcctcggccccaacggctccggcaagaccaccacgatccggatgctgatgggcctcatcgacccgacgtccggtaccgccgaggtgctcggccgcccgatgccgggcgccgcccgtacggtgctgccggaggtcggcgcgctgatcgaggggcccgcgctgtacggcttcctgaacggccgggacaacctcctgcgctacgacggggccgaccccaccgccgacccgcgcacccgccgggcccgcgtggacgaggttctggcacgggtcgggctcgccgccgcctccgggaagaaggccaaggcgtactccctcggcatgaagcagcgcctcgggctcgccgccgcggccggagcagggcggcggc

SEQ ID NO: 4060 - DNA, 3990 bp, Unknown
  Kingdom: Bacteria, Phylum: Actinobacteria, Class: Actinobacteria, Order: Streptomycetales, Family: Streptomycetaceae, Genus: Streptomyces
ctccgcgtaaacctgctgcggcagggcgtgccagaagttcgcgacgcccgccgcgaacgccttcgtcacctgatagccgctcaactcctcgtcgagcagcgccgccagcaccgcgtggcgcaacgccatcggaccgcctccctctccgtgccggccgggcccacccacccacccacccctgtccggaacaccgaccctcatgatagtcatgaaactgactagtcactttcatgactatgcagcacctctcagcgaggacgcacctcatcaaggaggacacatgaccaccgcagtggaccgcttccgcgccgccgtcgaccgtcgcgacctcggcgccctggacgacctgttcaccgaggacatccggctctacagcccggtgaagttcaccccgttcgagggcaggcctatggtgctgggcctcttcggcgtcctgctgcgcaccttcgaggacttccgttacgtcggtgagttcgcgggcgcctcgcagacgagtgccgacgggaccgaggccccgtcggcggtcctgctcttccgggcgacggtcggcggccgggagatccacggcatcgacctgctgcacctggacgacgacggacgcatcaaggagttcaccgtgatggtccgcccgcagtccgccgtccgggcgctgggcgaggcggtgctcaccggcctggtcgccgacggcctcgtccccaccccgtaagggcgctcggcggcagcgctccggatcagctcacccgcaccgcctccagggcgtccgcgaccaggcccaggaaccgggcgtggtcgcggggcccgtagaggggctcggggttccacgggacgacgggcgtcggcacgccctcgctcccccgcagctcttccagcggggccgcgtgggcgcggatgtcggtcaggatcacctcggggcgcagcgcgaaggtgtcggagcggtcgagcgtggaccagttggctcctgggccggcggccggctccacgacctggacgcccagctcggtgaggacgcgcagttcgggccacatctgggggcgcgcgacatgcgcctggtcccggccggccggggagagggcgagcacccggggcgcgtcgccggacgtggcggcgaccacggagcgcagccgctcccgggcggcgcccaggtcccggtccgcgcccggccgggccgtggcgccgagcgagcgggccagttcggcgaaccggtcgccgatctcaccgaacgtacgcgcctggctgacgtcgaggacgaccaccgggacccgctcctccaggggcttggccgtctcgggggtcagcccgtagacatgcccgccgccgtagctgacggccaccacgaggtccggcccggtgctcagcagccgctcgacgtccagggccgcgcccgcaccgacgtacgcgacctcgcccagcggcagggtcccggtcttcgccgtgtcggggtccggtccgtcgtggccggagccgaagatccccaccggccggattccgaggccccacagggtggccccggcctggacataggccagcacccgctcgggcggccggggcgccgtcgactgctgcccccggtcgtcggagaaccgccattcgctctgctccgtcatgtcgcacacgcccctctgccgccgactgccgttccattcgcgcgagttcgtacacgtgtacctgcccacctcctcgccgccacacccctctggccagggaacaaacgctcgtcaaccgggttcgggcgcgatgggcggcccgcatcacggagtgttagaaatgagggaccctcagtcatcgggcggcatcttcggccggccctctcccggacggagccaactccccatgcgcgcgacccttctgaaggcagccctggccgtcggcgtcggcgcatcgctctgtgcggcctcggcggacgccccggcaacggccggggccgcggcacttccggcggcggaagcggcgagggtggcgcggtgcccggtggtcgatgtgctggccgtctacacaccgaaggcggcgaagcgggtcggcggcgagcaccgggtgccctcgtcggcccagcggatcgccacgcggatgaaccggtccctggcggcgggcgggctctgcggcgccatccgcgtcgtccatccgtacacggcgaccggttacgagggctcggaggagttccgcgccgcgcacaccaccctcaaggaccactcggcggggctcggactccaggtgcacgaacagcgggcgcgatacggcgccgatctggtcacgctcgtcgtggaccgggcggaacggggcggcggcaccgcggactacactcccgcgctcgacagttccacggacgagtacgcctacgcggtcgtcgaggccgacggcatcggcctggattcggcgagccacgagatcggccacaatctgggcctcgcccacgaccgcacgacgctggcgggcgacacggacggttcgatgagcgtgagcaggaaccgtccgtacaacaccggctggatcaccgaggacggcaatcactacacgatcatggcgtaccgctccgcgtgcggggaccactgccggcggatcagccggttctccagcgcgacggagacgtggaagggccaccggctgggcgacgcggacaacgacggcgtacgggtgctgcgcgcgaccatgccgatcgtcgccggataccgcgacaagcgctgaaccggccacccctcggggtgtccggtggctcccgcggactcccgggtacgtgacgttttccggggtgtgtcacccgtcggcgccgcacccgtcacgggggcgcgcgccgtcgagcgtcaggtccacgatccggcgcgcgagccccctgtccagcggcgctccggtcagcaggacccgggcgaacaacggccccgccagggtctcggccaccagccgggcatcggtgtccggggccagctcgccgcgctcgacaccgcgccgcacgatgtcctcaccccgtcccagccgggcgtcccagtacggcagacgctccgcctcgacggaccccacgtcgggggaggcgccgaggtggagcagggcggcgccctgcggcgaggcgagatagtccgagaccgccgacatcagctgggtcaggtcgcggcgcacgtcccccgtgtcgggcgcgggcagcgcctcgtcggcgtgcgtgccgagagcgtccagcagcaggttctcgcgggtcttccaccgccggtacacggaggtctcgtgcacccccgccgccctggcgaccgcggccaccgtggtgccggtgagtccgtccgatgcgagcaggtcgacggtggccgccagcacggcctgccgcatgcgttcgccccggcggcgcagcggcgcggggctcttctcggtggtcacccccgaaccgtatcgcaaggctacttgctttaccgccaggccgggcctacgtttcaaagcaaggcgacttgcgataggccgccgatccgaaccgtaaggacccctcatggaacgcatgcgcgcagcgcgtctgcacctgcccagccgcaccctcgccgtggaggaggtggacaggcccgtgcccggtcccggcgaagtgctggtgaaggtcgaggcggcgggggtgtgcctctccgacgtgcacctcgtcgacggcaccctgagcccgatgtacctggagggggacacggtcaccctgggccacgaggtggccgggaccgtggcggagcgggggccggacgtcaccggctggtcgcccggcacgagggtggtgctccaggcgggcgagcagcgccggggccggacgcacacccgcggcgtcgactacgacggcggctgggcggagtacgccctcgccaccgcgtcgaccctcgtcgccctgcccgactcgctccccttcgagcaggccgcgatcatcccggacgcggtctcgacgccctgggcggcggtgaccgccaccggtgacgtccgggcggcggaggccgtgggcgtctggggtgcgggcgggctaggcgcgcacgccgtgcaggtgctgcg

SEQ ID NO: 4061 - DNA, 3385 bp, Unknown
  Kingdom: Bacteria, Phylum: Actinobacteria, Class: Actinobacteria, Order: Streptomycetales, Family: Streptomycetaceae, Genus: Streptomyces
cgtccaggtcgacctgggggccgagtcgatgctcgcccggcgccccgaggcggtcgccctggcccgcgaggtgggcctcgccgaccgcctccagccgcccgccaccgccaccgcctcgctgtggacgcgcgacgcgctgcgccccatgccgaaagggcacgtcatgggcgtccccggagacccggcggtgctcggcgatgtgctgtcccccgagggcctggcccgcatcgccgaggagcgcgacctcaccccgacccccgtcggcgacgacgtcgcggtcggcgcgtacgtcgccgaccggctcggccgcgaggtcgtggaccggctggtggagcccctcctcggcggggtctacgccggtgacgcctaccggatctcgatgcgcgccgccgtcccccagctcttcgaggcggtgaaggagggcgggccgctgctggagggcgtacgccgcatccaggagcgggccgccgtccggcagcagaccggccccgtcttccagggcatcgagggcggcatcggcaccctcccggccgccgtcgccgacgccgtacgggccggtggcggcgagatccgcaccgagacccctgtcctcggcctgacctgtacggagtccggctgggcggtccgcaccgacaccgggacgatcgccgccgacggcatcgtcctggccacccccgcctggtccgccggcaccctgctggccgccgagtccccggccgcctccgccgagctctccggcgtcgagtacgcctcgatggccctggtcaccctggccttccggcgggccgacatcgagcgccacgaggccctgcgcggccgctccggcttcctcgtaccgccggtcgacgggcacacgatcaaggcgtccacgttctccagcaacaaatggcagtgggtcgcggacagcgcccccgacctgttcgtgctccgcacctccgtcggcaggtacggcgaggaggaccatttgcaccgcgaggacgaggagctcgtcgccgtctccctgcgcgacctcgccgcggccaccggactcaccgcccggcccgtggacaccgaggtcacccgctggatcggcggcctgccgcagtacccggtcggccacctcgcccgggtcgcccggatccgcgacgaggtcgccaagctccccgccctgcgggtctgcggcgcggtctacgacggggtcggcatccccgcctgcatcgcgagcgcgcgccgggcggccgacgagatcgcgggcgagctcacgggggagatcgcgggagagatcatcgccacgtcgaccctggttcggggcacggggagcgaggcgggacaatagccgtatgagtgctcctgagactgtgacatcaagcaagagtccgaacgccggcaagaaggccaaggacctcaacgaggtcatccgctacaccctgtggtcggtcttcaaactgcgcgacgtgctcccgctggaccgcgcgggatacgccgacgaggtccaggagctgttcgaccagctcgcggccaaggacatcaccgtccgcggcacctacgacgtgtccggtctgcgggccgacgccgacctcatgatctggtggcacgccgagacctcggacgagctccaggaggcgtacaacctcttcaggcgcaccaagctcggccgcgccctcgacccggtctggtcgaacatggcgctgcaccggccggccgagttcaacaagtcccacgtcccggcgttcctcgccgacgagacgccgcgcgactacatcagcgtctaccccttcgtccggtcctacgactggtacctgctgcccgacgaggaccgccgccgcatgctcgcggaccacggcaagatggcccggggctacccggacgtccgcgccaacaccgtcgcctcgttctcgctgggcgactacgagtgggtcctcgccttcgaggcggacgagctgtaccgcatcgtcgacctgatgcgtcacctgcgcgcctccgaggcacgtctccacgtgcgcgaggaggtcccgttctacacgggccgcaggaagagcgtcgcagacctggtggccgggctcgcataaccagcgagtcccgcaccaccccaacccggaagatcagaagggcgggcaccgggcaccgaccgtgccgtccgctcctccagcgacaccgggttcggcttcgggggccgtcgcaccgtcatggtgcggcggcccccgctccgtaccgcccccccgccggggatcagtccagcgacaccgggttcggctccgggtgcgcggcgcagtccgcaccccgccccggcacctcaccggtcagcagataccggcgcagatgatcgtcgacgcaggtgttcccggccccgccgatgccatgcgtcccggcgtcccgctcggtcaccagcgatgacccgggcaaccgcttccgcagctccagcgcccccttgtacggggtcgccgcgtcccgctccgccgccaggatcagcaccggcggcagctcaccccaccgcgtcccgacctccagcggccgctgccggggcgcgggccagaaggcgcacggcaggttcgcgaaggcgttgtcccaggtctcgaacggcgcgacgcgcgccaggtccgtgtgatcgcggtcccacacctcgaagtcctcgggccagggcgcgtcgttgcactcgacggccgtgtacaccgcctgcgcgttctcgttgtccttggccgccaccgcacgcggggaggcctgcgcgaccagcggctcggggttgcctcggacgtactcggagagcgccgtcgcccgcatcgcccagtagtcgtcgtagtaaccggcccccaggaaagccgagtgcaactgccccggcccgacctttccgcccgcgggcttctccgccagctcggcgcgcacctcgtcgtagtgcttctgcaccgcctccggcgtggcccccagacggtagacgtcgtcgtgcttggccacccagcggcggaagtcctcccaccgtttctcgaaggccagtgactggcccatgttcgagcggtaccagatctgctccgggtccgggtcgaccaccgagtcgaagaccatgcgccgtacgtgggaggggaacagcgtcgcgtacagcgcgccgaagtacgtcccgtaggacgcccccatgaacgtcagacgcggctcgccgagagcggcccgcaggacgtccaggtcacgggcgttgttcagcgacgtgtagtgccgcagcgtctcgcccgcgtggatcgcgcagccttccgcgtacgccttcgcacgggcgacgcgccgctccttgtactcccgcgtcgggtgggtcggcgcgtcggtcgggcccttcgtgtacgccgccgggtcctgacaggtcagtggcgcggacgagccgttcaccccgcgcggggcgtagccgaccaggtcgtacgcctcggcg

SEQ ID NO: 4062 - DNA, 1340 bp, Unknown
  Kingdom: Bacteria, Phylum: Actinobacteria, Class: Actinobacteria, Order: Streptomycetales, Family: Streptomycetaceae, Genus: Streptomyces
gacggcggccgagcggctgcgcgagatggtcgacggactcccggcggtgaagaagccgttgatggtggtgaccgccgagtggctgcgcgacccctcccggcggctctcgctcctcgccgaggagcacgaactgcccggctggccgcgccggaactacgctcccctgctctacctggggctgctgtcggtgttcggcgactggttcggcacgaagtggagttacgccacgtacgacacggtggacacgcacgcgttgcgcctgacgtgtgtgcccgagtggtcgtcccaggccgcgggtgcccggtcgctggcccgcatccggctgcggctgcccgccgagggggacgtcgagatgtccgcggcgaaggagatggtcgagtacgtgctcgatcacccgggcgcggctccgggcgtgccccatctgacgggtgaactcctctccgcggcccgcctgcccaggcaggagcggcgtgaggccctgcgtcgcatgctgaacgcccggcactccccggcggccccggcaccggccccggaagaggagggccgtcccgcacggcaggaggagcggtacgggcacgaggagcggtacgcgagcgagcaccgggaggacgaccggtactacgggcgccaggaccgggaggagaaccggtacacgagcgagcaccggcaggaggaccggtacgcgctccaggaccgggaggatcgccctgagcaggaacgccgccgccttcaggaggagctgctggtccaccagcgcgtcgacaccgcccggtccgcacggctggccgcccggctccgggacctccgggacgcaccgctgctgacgctcctgtgcgccgacgcgctgccgtgggcctcccgcgatctcgtcctggacgaactggcccgccccgagcgacagcggtcccgggacgaagcgaccgcacacgcgctgtgcaccgaagtgctgcggcacaacctgtacttcagacccggccggtccgaggcggacagcccgtccgccccggagatgcgggagcgtgcggccgagctcttctcctgggccgtcgccccgctcgtacgggacccccaccgagcccccgatctccggccgctgttcaacatcgtcctcaaggacggtcgggacaccggcatggagtggctgcgccgcatcctggtcacgcccccgggcggccatgcccccgaccttcccccgcagctgtggcagcagatcgtgacggacctcctcgcccacccggtgtccgtaaccgcgccggcgcccgcacccacaccggcacacgtgccacccgccgccgtccctgcctctgcccccgcccctgctcccgctatgccgccggtac

SEQ ID NO: 4063 - DNA, 2170 bp, Unknown
  Kingdom: Bacteria, Phylum: Actinobacteria, Class: Actinobacteria, Order: Streptomycetales, Family: Streptomycetaceae, Genus: Streptomyces
agccggacgtcctccaccaggtcgacccccggcacccgctggagcacggcgaacgcctccccggactggacgggcctgccgaacggccagccgtccccggccggcccgccggtgagcgggttgaagtacccgtacagcgcggccagcgcgctctcgcggaccttctccgcgaccgccccgcgctccgcctggaccagggcgacgacggtgaagccctggtagaacggcggctcgacgaccagccgggccccgatcggccgccgggcgtccaggtgtccggcgatcagggcgagcgtgttcgcgggcgggatcagctcgtcgaactcgatccggccgtgctcgtcgccgctcccggcggggacgacgagcagccgcaccccgcccgcgtcggaagcctccgcgccgtcctgcgtaccggcccggatgcagtggacccgggccgcgtccggggcgatctcccgggcgaggatttcgtagtcgtgcgggacgaccgcccggtgcagggtgcgcagcgtcatcggcccgcgcacccgggcgctgtcgacgctctcgccgtccacgcccccgagcgccggccggcggttctcgacccgcgcgacgtacgggatcgcgctgcgcaggacccggagcgtggagcgggcgacgttgccgcgcagcccgcctcccctgcggtaggagcggacccggacggtggctcccttgaccgggacacggccgtaatggcgtacggagccgtcccgttcgcgtacggcggggccgaactcgacgcggcccgcgttcgggtcgagcgtgacgtgccggtcctcgggtccggagtgcgcgaagtcgtcgacccggctccagcgggtgacgtccgagccggcgacggcgtcgggcgcggccgggtcggtcacctcgaccacgaactctcccggcaccaccggcggtctggccagccggaacacctgcccgtgaacgccctccgcctggcccagcacctcgtcggtgatggtctcggcgtgctcggcggcgacggtcgcgccgatggtgaacgcggtgatgccgcgcacgacgggcggggccacgtacgtcggccggcccggctccgcctcgatcagccggcagcgcagccagcccccggtgcggcggacgacggccgccgggacatgggttctcggcaggtgcaggatcagctcgccggaccggttgaagccgccggtgtcgtccttctccacctcgcagaccgcccaactggtcccgtcccaggcctcccagaggatcggcggccgggccgggtcgaccccgacgccgtcgaccgtgcagtccagccggagcgcaagtacgcctgcgggcacggcggtcgacagaccgacgtacaggcagtcgccgggggcgggcgtggccccgaagacgggcacgtccctgccgagcgtcagctcctcggtccggtcgacggcctccccgggcgagggccaggtggccaggtgggcaaaggcgcacggcacgatggagagcggctcggaggtggtgaagacgaccgcctcctccgtctccgtacggacggtggcgacctccgttccggcgcgcaccagcaccggttcgggccggggggcggagagccggaacgtcacctcggtgtgggcggcggtcggcgggtggagctgtaccccgatcaggtcgagaaaggtcagatagctcttctccgggacccggttcacccggtagacgagctggtcgaccatggtcgcgaacgcctcgatcagcgtcaccccggggtcggagacgttgtggtcggtccactccgggcagcgctgctgcaccaggcgtttcgcctcgtcgaccaggccctggaaggtgcggtcgtccagatgcgggctgggcagggtcacgccctcgcctcctcgtcgtgcgggccgggcagggtcacgcacccgcctcctcgtcgtcggccggtgcctcggcggcctcggcgtgctgcgggatcacgtagaacgggaagacgaggttgcgcgggtcgttcgcgccgcgcacggtgtagccgatgtcgatgtagaggacgccgttgtccgcctcgtcgaaccggacgacgacttccgtcacctcgatccggggctcccagcgctccagcgcgagccgcacctcgtacgcgagttgcccggcggtccccgcgtccgccgggcaactcgcgtac

SEQ ID NO: 4064 - DNA, 2134 bp, Unknown
  Kingdom: Bacteria, Phylum: Actinobacteria, Class: Actinobacteria, Order: Streptomycetales, Family: Streptomycetaceae, Genus: Streptomyces
ggtgctgcgcatgctccgcacggtcgggcccacgcatctggccgcccggtacggctccggccccgggacgggctcctactgcgacggctgccgggcgctcggcggcgacgaggcggcggcggccggggcccgcgccgtggcgggcggggcggccggagcgctgctggacctgacggccgcggtgcgcggctcccgggagggcgcgcagggcgtcgtgcgccgccatggctgcgcggcgtacgcgccgctggtcgtcacgggcgggccgccggagaccgaagcgcaggacctccgatgaacgcggcgaccagcgccgtggcgctcggcaccacgggggcctccgcacgtctgcgggtcaaactcctgctgctggagccggagttccgggacgccacccaccacatgtggcgtgccgacgggctgttgccgcgctaccggacgtatctgtgcaccatgcacgccgtcatccgcgcctccgtcccgctgatggagctggccctcgaccgcgcccgcgtccgggccgcgtccggcgatccgctggcggcgccgctcgccgcgtacctggaggagcacatccgggaggaggagggccatgacgcctggctgctggaggacctccgggtcgcgggcggcgatcccgcggacgcgctcggcccgctgccctctcctctggtcgcctcgctcgtcggaccccagtactactggatcgagcaccaccacccggtcgccctgctcggctacatcgccgtactggagggctacgcgcccgcccccggtctcaccggccgtatcgcccggctgaccggactgcccgccgccgcgctgcggaccgtacgggagcactcggtgatcgacacggagcacctggacgagctgtacgcgctgctggaccggctgccgctcggccgggggccggaagcggccgtggcggtcagcgcgctgcactccctcgacgcgctcacccggctgttcgtccggctcgggcgctccgcaccggcgccgtcgctgcggggagccggacctgtcccaccgatgggagtcacaccatgaccggaccacccgagaacggccgacggccggtgctgcccgacgcgttgtacgaggcgggcttccccgtcgacctgctcaccgaggagcagcgcgaggtgctgagcgggctgaccccggaggaactggcggtgctgctggacgtcaagggccggctggacgccgtggggccggaggtccaggcgcacggcgagatcgccggcggcgccctgttctgaccggcggccggtgaccgctcaccgttacgggcccggcgccggtttcaccgccgccgggcccgtacacgccgggcgcgcgcgcccggtgaacccgcctgcaccccctgaccgcacggcccccgggagagaaggacccgccatgaactgctcctcgtgccagcaggatctgccgccgacggcccggttctgttcgtcctgcgggacgccgtgcgcgaccaccgggaccgccggggccggaccggccccggccgcacccgccggtgacgaacgcaagccggtgaccgtgctgttctgcgatctcgtcgggtccaccgcactgtccggggtgctcgacccggagacgctgcgtacggtgaccctgcggtacttcgaggcgatgagcgcggagatcgtggcgcgcggcggcaccccggagaagttcatcggggacgcggtgatggcggtgttcggcgtaccggtggtccgtgaggacgacgcccgccgggcgctggccgcggcgctcgggatgcgccgggcgctggcccggctgaaccaggagctggatgccaccctgggcatcgagctgaccacccggatcggagtcaacaccggtcaggtggtggcgggttcggacacgaccgcccggcaggccctggtctccggggagaccgtcaacatcgccgcccggctggagcagaacgcgggacccggcgagatcctgatcggcgcggaaaccctgctcgccgccggcccgacggtgcgagcagaacccaccgggccgctgcggctgaagggcaagcgggacagtgtggaggcccaccggctgctggcgctgggcgccgacgaccccgaactgctgcgccgcttcgacgtccccttcgtcggccgcg

SEQ ID NO: 4065 - DNA, 1172 bp, Unknown
  Kingdom: Bacteria, Phylum: Actinobacteria, Class: Actinobacteria, Order: Streptomycetales, Family: Streptomycetaceae, Genus: Streptomyces
gcgcctaccgcgtcggcacccgccgccaggcatcgccaggccacgcgggcgccgacgcggtaggcgctgagcagggcgtccatcgaacggccgtcgcgcacctcgccgcggcccagctcgtaggctgcgtcaccgccgtcgccgcctgtggcgttcccactcgcgaggtccaggtagttccccagcgcggtgcggacggctctgcggatggtgccgcccatacggcccgagagggcgttggcgtaggaagggacctcgtcgatgatcgcctggacgacctcgtcggcggtggtcttcagcgcggcacgaagtgcggtaaccgtcgtctcgtccagggccagttcgctggccctccggattgcatggctcacgttttgttccctgcgaacaattcagccgatcagattcacgtcctgcggtcaggactttacgccacgaggcacagcaagctggagtcatgacgagtgcagccctccgcagtagggcgtggaaactgctggagatggtcacgacgccgctgctgccgtcggactacctcgacctggtcagcccgttgcgtgcgagcgccgaccttcgtgggcgcatcgaggccgtgcaccccgagaccggtgacgccgcgacgatcgtgatcaggccgggacggggctggcgcggccacacggccggtcagtacgtgcggatcggggtcgatgtcgacggggtgcgcctgtggcgtgcctactccatcacctcgccgacaaaccgccgggacggccgcgtcaccatcacggtgaaggcgatcccggacggcaaggtcagcaaccacttggtccgcagagcgaaaccgggcacgttgatccagctcgatcagtcgaccggtgacttcgtgctgtcgcaggccgagcccgccaaggtgctctacctgacggccggcagcggcatcaccccggtgatgggcatgctgcgggacaccgatttcgacgacgtcgtcatggtccactgcgcgccacggccgcaagacgtgatcttccgcaaggaactgcacgacctggtcgcggacaagaagctgcggctcaccgaggtgcacaccgacacggacggcgtgctcgacatcgcgcgtctcgacgaactcgtgcccgactgggccgagcgcgagacctgggcctgtgggcccgcaggcctgctcgacgccg

SEQ ID NO: 4066 - DNA, 1181 bp, Unknown
  Kingdom: Bacteria, Phylum: Actinobacteria, Class: Actinobacteria, Order: Streptomycetales, Family: Streptomycetaceae, Genus: Streptomyces
gccgaggcgctgaagctgaagccgggctcgcggctcaccgtcaccgaccggctgcgcgacaggaagcagcgggtcctggtcaccggcgtctacgaggccgccgaccaggccgacccgtactggcagttggacccgctcggcgggcgcggggtgcgcaagctcgccttcacgacctacggcccgctgctcaccgacccctcggtcctcgcctccggcgtgctcggcgagggtgagacgtcctggctggcgtccgccgacttcgccgagctgaccaccgggtccatggaggggctgcgcgaggcgtcggccggcgcaccgaaggcccttgcggcagctccggtgttcgcctccgggatcaccgcgaagacctctctgcccaccgtgctcgaccagctcgaccgggcgctgctggtctcccgttccacgctgatgatcgtcgcggtgcagctggtgctgctcgccgcgtacgccctgctgctcgtggcccggctgctgaacagcgagcgggacggcgagcgcgaactgctccgggcccggggcgggtcgcgaggccggatcacctcgttcgccgcgatcgaggcactgttgctcgccgtgcccgccgcggtggtcgcccccctgctcgcgggaccgctgaccgggctgctggccgagcgcagcgctctgtcccggatcgggctgaaggtccaggaggcctcgaccggcaccgtgtggctggtctccgcggccgtcgcgctggcctgcgccctggccgtggtggccccgtcgctgacggccgggtccggcgggcgcaggacccgggccgcgtcgctgcccggtccggtgcgggcgggtgcggacctcgggctgctcctgatcgcggcggtggcgtactggcagttggaccggcagtccggcagcggggcgctcagcggcgaccaggcgggcaacctcgggatcgaccccctgctggtcacggcccccgcgctggcgctgctcgcgggaacggtcctcacgctgcgcctgctgccgcccgcggcgaagctcgccgaacggcgtgcggccaagggccgggggctgcccgcggccctggcgggctggcagttcagccgccgcccgttgcgcggcgcggggccggtgctactgctggtcctggcggtcgcgatgggcatgctggcgatcggccagagcgcctcctggaa

SEQ ID NO: 4067 - DNA, 2110 bp, Unknown
  Kingdom: Bacteria, Phylum: Actinobacteria, Class: Actinobacteria, Order: Streptomycetales, Family: Streptomycetaceae, Genus: Streptomyces
gggcaggggtgggagcagcggtggccggggattcggcagtcggttccgcttcccgttgcctctcggggtccctcgcgggctccgccacggattccgtcgcgagttccgtcacgggttccggggccgtacgccccaccgcttccgagcggggggaggcgccgaccgagtgggacggcaccagctcctcggcacgggggcgggtcccgtccgggacgccggcgggggttccggttcccgttccgctttcccctgccgggcccgcggcggccggctccggaacggtccgggcgccggaccccggggccatcccgtcgcggcgggcgaggacccgcaggagaaccgggcgtacgacctcgcccacgaggagcgccagcgtcaggtagagcaggcaggccagccacaggaaccccggccaggccagcacctgctggagccagaagggcgctcccacccggccggacgtcatggcgccgatgctcagcagcggcaggacgaaggccgcgacggtgcccgccctgcgcagcggactgcccggctccgtcgtgtcaccgacgaagcggcgccacagataccggtgcacggcgccgagcagcgccagcaccacgagtcccaccagagcgaagaccactgctgccatccgagcttccccatgttcccgtcgtcatgcgcggtcgtcgcgcaaagcccggactccgcgcaacccgatcacgccgaccgccgtccccagaagaaaggacgtgatggcgagcagcaggtgcacccagaagtacccggtcggttcgcccgcgtcgtcgaaagcgagcccgctgccgtcctgccacaggttcttgacgaaagtgatccagatgaaccagctccacaccccgaacgcgagcaggaaccaggacacgcggcggctgagcttcatgggtccagtatcgccgccgccccccggccccctcctccggggtggcgtccgaacggggccgtcccggcgttccctgcggcgggtcagccggtccgggtccgcatccacaccttcgccctgtacgtttccgaccgtgcctgctctgaaaaagatcgctctcacggtcacctccgccgccttgttgtccggtttcgtcctcagtcccgcctcggcggccgacaaggacaagagcgacgacaaacagcccaagccgccgagcacgatgtccagcctcggcggggagcagctcggcaaggccggcacccaggtcaatctgggcccgggtgcgccggtgctgcccaaggagctgaccggccggtcctggatcgtcgcggacgcggagaacggcgacgtcctggcggcgcacaacgcgcactggcggctgccgcccgcctccacgctgaagatgctcttcgcggacaccgtcctgcccgcgctccagcccaccagcctgacccacaaggtgacggagagtgagctggccggggtcggcgagggcagcagcctggtcgggatcaaggaggaccacacctacacggtccacgacctgtggctcggggtgttcctccggtcgggcaacgacgcggtgcacgtgctgtcggagatgtacggcggcgtcccgaagacggtggccgcgatgcagaagcacgccgaggagctccaggccctcgacacccgggtggtctcgccggacgggtacgacgccccgcgccaggtctccagcgcctacgacctgaccctgatcgcccgcagcggactccagaagaaggacttccgcgagtacgcggcgaccgcttcggccgacttccccggcgaggagaagaaggggaagaagcgcgactccttcgagatccagaacaccaaccggctgatcaccggggacatcggcgtggacccgtaccagggcatcgcgggcgtcaagaacggctacaccacccacgcgggcaacaccttcaccggcgtcgccgagcgcaacggcaaggtcctgctggtcacggtcatgaacccgtcggcggaggagagccacgccgtctacaaggaggccgccggcctgctcgactggggcttcgccgcgagcggcaaggtgaccccggtcggcgagctggtgccgccgaagtccgtggacaccgggaccgcgaccggcggcaagggcgcggcgcccgc

SEQ ID NO: 4068 - DNA, 2143 bp, Unknown
  Kingdom: Bacteria, Phylum: Actinobacteria, Class: Actinobacteria, Order: Streptomycetales, Family: Streptomycetaceae, Genus: Streptomyces
cgccaaggtcttcgacgccgtcgccccctacggtgtcccccgcatccacttcggcgtcgaagaccttggcggaggcgggcagcaccgcgcggcggtagtcggcgggggccagtgcgccgacccaggagtcgaagagctggacggcggaagcgccggcctcgatctgcaccttgaggaaggcgccggtgatctcggcgagccggtcgacgaggtcggcccaaagctgcgggtcgccgtacatcatggccttggtgcgctcgtggttgcgcgaggggccgccctcgacgagatagctggcgagggtgaagggggccccggcgaagccgatgagcggggtggcgcccagttcggcggtgagcatcccgatggcctcggtgacgtacgggacgtcctcgggggtgaggtcgcgcagccgggccaggtcggcgcgggtgcggatcggctcggcgatgacggggccgacgccgggcttgatgtcgaggtcgatgccgatggccttcaggggcacgacgatgtcgctgaagtagatcgcggcgtcgaccttgtggcggcgtacgggctgcagggtgatctcggcgaccagctccggcatcatgcaggagtcgagcatcgcgatgccctcgcggaccttcaggtactcgggcagcgagcgccccgcctgacgcatgaaccagaccggcgtgtgcgggacgggttcgcggcggcaggcccgcaggaacgccgagtcgtgggtggcgtggcggaccgcgtcgaggctggcggaggtcgtcgtctgctggcccgaagggctgtcgttggcactcacgcacagaatcttcgcacgcgcgccgaaggagcccggccccgcacgggtgtctctccctgcgcgaggcccggcttccgcctactcttccccgcatggctccggctcagggacaattttccgatcattccgatggcgttgaaagcaaggacggcacggagggaccttccgtgccacccgcgttcctggcggcggtcgacgctctgcgttccgcgcgcctgcgcccggagctggaggtggaggtgaccaggccgccccagcgcctcgctccgcacgcgtacgccctggaggcggcggtggtggacggcgaggacgatctcgccgacggcaggctggtcctgctgcacgatccggcggggcacgacgcctggcagggcgcgttccggctggtgacgctggtccgggcggagctggagccggagatggcggcggacccgctgctgccggaggtgtgctggtcctggctgacgggtgcgctggacgcgcggggcctgtcgtacggagaggccggcgggacggtgacacgcgccggatcgcactacttcggtgcgctgtccgcgcgccgcccggcgacgcagatcgagatccgggcctcgtggacgcccagggagtcgcgcggcggtgtgccggacacggcgtcgcacctgatggcctggggtgatctgctgtgccagatcgcgggactgccgccgtcggatccggcgggcgcggcggtggtgacgttgccgcagcggcgcgggccacaggtttagtaacactccgtcacccgtttcgcacaagcaccggctctcttttcgtacaatcgatcgcgcgtcctatttgcccgaattgttactcaccaaatcgcgatcttcccctaaaggaggacgggtccgctgccgaagaggtcaatgacccttcaagcacggttcgcccccggcttcaccccccgagccggcccgtcccgccactcccccaggaggcctggtgtccgttctccttgagcagcccgcaagcctggtcgcctaccgcccgaacaagccgacggccatggtcgtcgtggccgacccgcgcgtccgttccaccgtcacccgccatctgtgggccctcggagtacgtgacgtcatcgaagcgtcgtccatcgcggaggcacgcccccgcgtcggcaacccgcgcgacatctgcattgccgacgtccacctgcccgacggttccgggctgaccctgctgtccgagacccgcgccgcaggctggcccaacggtctcgccctctccgccgccgacgacatcggcgccgttcgcaacgccctcgcgggcggcgtgaagggctacgtcgtcaccggcacccgaaccaacatcggc

SEQ ID NO: 4069 - DNA, 1100 bp, Unknown
  Kingdom: Bacteria, Phylum: Actinobacteria, Class: Actinobacteria, Order: Streptomycetales, Family: Streptomycetaceae, Genus: Streptomyces
  misc_feature (507)..(508): n is a, c, g, or t
  misc_feature (741)..(742): n is a, c, g, or t
cctcgaagggtgccgacaagggcacggagcagggtgccgccgaggagcccgacgcgaaggacgggggcagcgcggaggggtccggcgccgacgccggcgacggcacgaaggtgccggtccagcaggcttgcggcgccaacgacatctcctggagcacccggtccgagagccaggccggcggctacatcctggtcatggcgaaggccaagcaggggatcacctgcatcctgccggccgcgctcccgacggtggcgttcggctccgacggcaccgaggcgggccccgccgagcagtcggtcggcgacgccgtcacgctgagcggcaacaccaccgcctacgccggggtgaacccgaagaccaccaacaccgacggcggcaaggagctggactccatcatcgtcggcgtcggcaacgaggaccccgacccggtctccctggaggtcggcaccatcacggtcgacaagccggtcgtcaccaactggcacaccgccccggccgacgccgttnnggccggggcgggtggaccggtcctcagtacccgtagatcatcttgtacgcgacctccggcaggaactgcccggccacggagccggcgccgacaccgcagtcgccgtcggactctccgggggtcttcagccacagcagcatctcggccccgccgcccgtctgcgcgaccgaccccgtcctgcgtccgcccgggttgcaccacgcgccgttggagccgttgccgttgcggctggnngacggcgttgccgtacgcggagttctcgccggtgccgtagtagttcgagatgttcagcgagaagccgtgcgcctgccgggctcccgctccgtcgaggtgccgcgccatggtggccgcgccgatccaggccgggtttccggcgtccaggtaggtccatgtgtggggtgcgtgggcggcgaactgtgcgagcgcgtccctcagcatcccgttgcgctcgtcgatctgagcctggttcaggcagctgaagtcacccagggagtcgggctcgatgaccaccagcgccggccgtgtgccgatcgccgaggcgaacgcggagatccaggcgtggtacgcgcccggggtgcccgcgccgccgccg

SEQ ID NO: 4070 - DNA, 1666 bp, Unknown
  Kingdom: Bacteria, Phylum: Actinobacteria, Class: Actinobacteria, Order: Streptomycetales, Family: Streptomycetaceae, Genus: Streptomyces
gagcgcggcggcgaacaccgcgccgacggtgacctcggacagtcccgcctggaccacgccgatgcggctgctcacgccccacagcgcgttctgcgccatggaccagacgagcatgccgcccgccaggacgagcccggaacggcggtgcgggagccggccggtgaccggcgaggcggtctcctcggccgccgtcgcaccgccgagccgggcggtcgcgggccagacgagcagggcgaccagggcgatcgcggcgaacggaagccggtggccgccgcccaggtgagggatcgtcagatagaggacgcccgcggtggcggacacggtgaggagcccgagcgaggacgtccggtgcgggtcgcgccgggcggcgatcccggccgcggcgaccgccgtcgccgtgccggagccgaacccgccgaccacgacaccgagcaccaccagcggcacggacccggcgagcgcggcgcacccgtagccgatggcggccagcaccagtccgacgcgggcgggggtgcgggccccgtaccgctcgacccggcccgccagggagaagccggcgccggccgagctgaggagcagggcgctgccgaccaggcccgcctgggcgggactcagccccagttgggcgctgagccggccgacgatggtggggaggaggtaggaggcgaggtaaccggcggtgaacacggccaccaggggccacgcggcaccagggcgcgaggacatgggcgttcctgaagacatgcctgagcaggcagggggaggggagggggtggagcgggcacagcgaagcgagcgggggcatgcgaaggcatggaggtattgcaggggtttacagcgagatgctgagatgtgcggctctcgtcggagaaggtcccccgaaggtgctcgcggggcaatttgtatcaagcgctcacggctccccgaaagccgccccgatgtgatctgggtcacttatgcgtttatgcaggaaaaccccgggtattagcgcatgtttatgcaggtcaggcgtgctgcgaacacctgggcgcggacactgcgttccccggggcgcatcgggcagactggccgcaccctcacacggtccggatcccgccgggacccgccgcacgaccccgggagcgcacggtgagcacagacactccgggcatcgacccgctgcaggcgctgcgcgccccccgggatcccgcctgcgacgtcttcctgacgggcccggtcttcctcgacatcatcttcaccggcctggacagcgctcccgtgcgcggcaccgagtcctgggctcgggggatgggttccagccccggcggtgtcgccaacatggccaccgctctcgcccgcctcggcctgcgcacctccctcgccgccgctttcggcgacgaccactacggggagtactgctgggacgccctcgaacagggcgagggcatcgacctgtcgatgtcgcacaccgttcccggctggcactccccggtcaccgtctccatggcgtacgagggcgagcgcacgatggtctcgcacggccacgaggcgcccgctccgaccggagcccccgcgtccaccggaaccgcaggagctcccgccccggccttcccgcgctgcccgccgcgcgcccgcgccgccatcgcctcgctcgccctcgtacgccatggagacggtgaccggggag

SEQ ID NO: 4071 - DNA, 3094 bp, Unknown
  Kingdom: Bacteria, Phylum: Actinobacteria, Class: Actinobacteria, Order: Streptomycetales, Family: Streptomycetaceae, Genus: Streptomyces
cccgcgagctgtctcccggggcgttcctcgccccccgccccctgctgccgtgcgcggaccgcctgcggatcgccctcgtcggcacccgggcgggactgctggccggcgacgatctgcggctgcacgtctcggtcggcccgggggcccgcctggaactggtcgaaccctccggtctggtggcgtacgaccaccggggaggcagatcagcctggcgagccagggtcgacatcgcggcgggaggccgactggactgggacgggaagccgttcgtggtcgcgcacggggcatgggtcgaccgcacgatggaggtgacgctcgcgcccggcgcccggatgctgtggcgcgacaccctcgtcctgggccgctccggtgagcgcggcggccgcgtccgggccaggacccgggccgtgtacgacggccgggaactgctggtcgaggacctcgacctgagcgacccggggatgcgtgaactgcccggcgtcctcggcccgaaccggatcatcggctccgtcaccgtcctcggcgcccgcccgccaggacctccccacccctaccggacggacctcgcgggccccggggcccaggtccggctgctggacaccgaggcgccggcgatggaagcggagctgacggcgctgcacgagcactggcggaccgggaacgtccgcgcatgacacgtatcaagggcgtcccagcaacgcgaacgggttgggcaccgcccccgtccagcggtgcagcaccgcgcgtccggtccgcagcgtggttcctccggagtcgaccgtccccgcctcggccacgtaggagcggccgtcgtcgagcgagaccagaccgtactggccgcccgactggtacccgtacaccccggacggctcgtggtgcagcccgcgcgggaggagggagacgaggcggccggactcggggcgcggctgccccttcacctctccccggcgggcgggctccgacccgtccaccacgtagagcgagtagttgggaaaagccgtcttcctgcccttgtacacggccatcagccagttgccgctgtgccggtcgtactccaggttctggacgccgtacgtggtgttgccggtgtaggcgaagaacttgccgtcgggagaggcggggccgctggtgtgatgagctccttcgacgagcggcctctcgtaccttctccagccgcgcacgtcgtactggagcagcacctggtggtcgttgtcggcgcgggtggtgttcgcgtagatcccgtacgcgacggtcagccggccgccgccccggtggttcagatcggggccgaaggcgacgccgtcgatgccgctgcagccgtagcggtggtcgggggtgttgccggtgtcgccgtcgaagaccccgtcgccgttcatatcggcggtgtagtcccgcacgacctcccggagatggacggtggagaccacatcggtggtccgggcgtccatgttcatccgggtgatgcgggccccgtcgaagatcgcgacgtagaacgcctcggcggccttgtactccagggagccgtacacccgtccgtcgccggtgttgaagtccagatcgcccaggtgcccggtgaagccggtgaccgagccgatcggtctgcccgacagatcggtcttcaccagcagatcggtgaaggagaagtacatgtggcccttgcggcggtcgatggccgtgccctggagatgcccggacgaccaggccccgccgtcgacggaggcgggcagcgacggcgacggcgtacgtgcatgggccgcacccccgcccaccgccaggagggccgacgcgacgacggcggacaggaacagggcggcgatgtgcgcgggtgctcggcttcgcatggttcctccgtgatcgtggtcctgggacgtgcgacgcccaccggaggcgggcggtgcctcaggccctgccgtgggaggcccgcgaacgccgtgccacggcatccaacgacaccgccagcagcagtaccccgccggtcaccatgaagcggtacgcggagtcgagattcagcagcgtgagcccactggagatggactggatcacgagaacgccgagcagtgcggcgaacgcggtgccccggccgccgaacagactggtgccgccgatgacggccgccgcgatggcgttgaggttgacgtcaccgccgccgctgctctggttggccgccgccagtcgcgaggcggagaggactccgccgacacaggcgagcgtcgcgcacagcacgaacgcggtggtgaggacggccttcacgttcacgcccgcacgccgggcggcctccatgttgccgccgaccgcgtacatcgacttgccgaacgaggtgcgggacaggacatagtgcagcgccagtaccagggccaggaagaacacgaacatccagcccaccccccggtcccggttgagataccagaccgccgcaccgaggccggccagcagcgccaggctccgcccggcgagcagacgccgggaggaggcggtgagccccgcccgtcggcgctccgccgcccgggcggcaccggtcgcgtacagcaccgccgcgcctgcgacgaccagcgcgtacgccaaccagggcggcaggaaatggagttgggcgaaggccaccagacccgagtcgaagggcaggttgatcgagcccttgggcccgagtatccacagttgcacgccgaggaagccgaggagtccgccgagggtgatgacgaagctgggcaccccgatccggttgtggacctgggcgtagaaccagccgatcagacccgcgagggccagcgcgacggcgacggcgagccaggccggcagaccccggtccacgaagaggaccgccagtacggcggcgccgaggccgctgatcgagccgaccgacagatcgatctggccgacgaggaggacgcagacgactcccagggcgatgatgccgaccggcacactttcgagagcgaggttcgtgaggttcgcgctcgacaggaagatggggttgaggatctgcatcacgacccagatcacgaccagcccggcgaggacgggcagcaggccgagatcgccgccgcgcagccggtcggacaccgcccgccgacggccgcgcgcaccggtcgaccggtgc

SEQ ID NO: 4072 - DNA, 2956 bp, Unknown
  Kingdom: Bacteria, Phylum: Actinobacteria, Class: Actinobacteria, Order: Streptomycetales, Family: Streptomycetaceae, Genus: Streptomyces
ccgctcaccggccgtccttcggcgtccaccgagcggaacgggcaggcggcgggggtggccgctcgcgtactgtgctgtgcgggggcaggtcgccacgaccgcggcacgtccccgccgacgtccggggcgaaccagagcgaggaagcacgtggcagagcacaggccgtcggaccaccggccgtcggagaaccggcccggagtgaccggcgcccgcagggtcgtcgtcaaggtcggctcctcctcgctcaccacggcatcaggcggcctcgacgccgaccgggtcgacgccctcgtcgacgtcctggccaaggtcagggacggcggcgaacgcgaggtcgtcctcgtctccagcggagccatcgccgccggactcgccccgctcggcctcgtccgcaggcccaaggacctggcccgccagcaggccgccgccagcgtcggccagggccttctcgtggcccgctacaccgcctcgttcgcgcgctacggcgtccgcgtcggccaagtgctcctcaccgccgacgacaccagccgccgcggtcactaccgcaacgcctacagcaccctggacaagctcctggagatgggcgccgtccccgtcgtcaacgagaacgacaccgtcgccaccgacgagatccgcttcggcgacaacgaccggctcgccgccctcgtcgcccacctcgtccacgccgacctgctcgtcctgctgtccgacgtggacggcctctacgacggaccgcccgacacccccggcgcctcccggatcgccgaggtcaccggccccgaggacctggcgggcgtcaccatcggcagcgcggggaaggcgggcgtgggcaccggcggcatggtcaccaaggtcgaggccgcccgcatcgccaccgccgccggcattcccgtcgtcctcacctccgccagccgggtcgccgacgcgctggccggccgcgacaccggcacgtacttccaccccaccggacgccgctccgcggaccggctcctgtggctcgcccacgcctccaccccgcagggcgcactcaccctcgacgacggcgccgtacgggccgtggtggagcggcgctcctcactgctgcccgccggaatctccgccgtcgagggcgagttcagcgccggcgacccggtcgaactgcgcgatccgcacggcaccccggtcgcccgcggactcgtcaacttcgacgcgaaggagatcccccagctgctcggccgctccacccgggatctcgcccgtgaactggggcccgcctacgaacgcgaggtcgtacacagggacgatctggtcctcctcgcgccgcgcctcaccccctgaaacggctgaaagtcccgtcttccggcggggaccttccccaaaaccaccccacgcccggctgtggactggtccactttgtagtggggaaacaggggtaccgcacagcaacacatcacaggaggccgccggtgagacgagcgcgcccgggggcgccgccccgaggcacggccaaccgcgccctgacgagtgtcggagcgggggcggatttcgaccggaatcccctcccggcggacaccgtcgaacgggagccggtgacgacggcgaaggaggagtccccgcagtcgaagctctggcacatcacgctcagcgtgtcgggcgccgagactccgctgggggaggtcagacgcggcctggaacagctcgcgcacgaccaccccttcctgctgaccagccgctacgcaggcgaccacgcggagatccgctactgggaagaggcccgcgatctgcacgacgcggccgcggtcgcgctgcggctgtggggcgagcaccgctccagcgcccagctcccgccctgggagatcgtcggcctcgaagtcatcgaccgcgagacctaccacctgcggatcgccgagggctacgggccgccgcccgcggcgccggtgggcgtgcacccctactgagcccggggagatccggaccgaccccgggcgatccccgggtggcccgcgggcgatgcgtggcgagatccggggcgtccgcccctcgggtcggccgtctcgcatcacgggatacgtgacggatgcccgcagagtgcgcattactctgcgggcatgaccacgctctcgccctacgacaacctctccccggtcgcgcagaccgcctaccgggcccgtgccgccgccgccgacatcgcgccacttccgcgcgcggccaaggacgacgcactgctggccatcgccgacgccctcgaagtgcgcacgagcgagatcgtcgaggccaacgcgcaggacgtcgagcgcgcccgcgaggccgggacgagcgaaggcatcatcgaccgcctcaccctcaccccggagcgcatccgcgccatcgccgccgacgtacgggacgtcgctgccctccccgacccggtcggcgaagtggtgcgtggctcgaccctgcccaacggcatcgacctccggcaggtgcgggtcccgctcggcgtggtcggcatcatctacgaggcccggcccaacgtcaccgtcgacgcggccgccctctgcctgaagtccggcaacgctgtgctgctgcgcggctcctcctccgcctacgcctccaacaccgcgctcgtccgggtcctgcgcgacgcggtcggcggctccggcctgccggccgacgcggtgcaactggtcccgggcgagagccgcgactccgtacgcgaactgatgcgggcgcgcggcctggtcgacgtcctcatcccgcgcggcggcgcctcactgatccgcacggtcgtcgaggagtccaccgtgccggtcatcgagacggggaccggcaactgccatgtctacgtcgacgcgcagacggatctggccatggcggtcgacatcctgatcaactccaaggcccagcgccccagcgtctgcaacgcggccgagaccctgctcgtccacaaggacgtggcggacgtcttcctgccgctcgccctggacgcgctggccg

SEQ ID NO: 4073 - DNA, 1481 bp, Unknown
  Kingdom: Bacteria, Phylum: Actinobacteria, Class: Actinobacteria, Order: Streptomycetales, Family: Streptomycetaceae, Genus: Streptomyces
gttcgccctgcaccgcgcgggcgcacggccgaggtgaccgacggcgtccgccgggtgctcagccgggaggcggcgcacctggaaccgtgggcgcggtgtgtcgcggccacgggggtgtgggcgtaggccctccgcccggtccgcccggttaggcgaactgccccacctggtagccgccggcaggctgctggaggatgacgttcagccggttgaaggtgttgatcagcgcgatcagggagaccagggcgaggagctgttcctcgtcgtagtgcttggcggcgttcgcccagacgtcgtccgggaccccgcccgccgcgtccgcgatgcgggtgccctgctccgtcagctccagcgccgcgcgctcggcgtcggtgaagacggtggcctcccgccaggcggcgatcaggttgaggcgcagcgaggtctcccctgccgcggcggcttccttggtgtgcatgtccaggcagccgccgcagccgttgatctggctcgcgcggatcttcaccagctcctgcgtcaccgcgggcagcgtcgtgtcctcgacgaccttgcccgccgagaccaggtgcttcacgagcttgcccgtgaccgggctggcgaaggcgttgagtcgggcgttcatggtgtgctccctctgctgtcgtccgggggttacacacacaggacggacccggccccggaggatgtgacatcagggagggtgacggccgtcacgcgcgagggggcctcgggccctcagcgcgactcccgtgccaccctcttcgcgatcctctcggcgtccagggccatttcgcggagcatcccgctgatcgggttggtgaagccggtgaagtacagccccggggcccccttcggcgagcggccgccgtgggcggccgggcggccccgcccgtccaggacgtccaggtggccgagcagcggctccagggcacggtcgtagccggtggcggcgatgacggcgtccggggtgaggcgggtgccgtcggccaggaccacggtgtcctcgtcgaaggaggcgaccgtcgccaccggggtgaccgcgccggtccggaccgcgtcgatcaaccccacgtcctggaccgggatcgcgccctgccggacccgggagtacaggccggtgtcggggcgggggaggccctgggcggccaggtcgggcacggcgatccggcacatcacggctcccgtgcggtcgacgagccgcaccgggaggcggcggaccaggctgccggtggcctgggccggccagcccgcggtggagcggcggacgatgtgcgggaccgtccgtaccgcgatgcgcacccgggacgcgccgccctccgcgaggtccgcggcgatctccgcgcccgtgttgccgatgccgacgaccaggacgtcccggtccgcgtacggggccggggcgcggtactgcgctgcgtgcagcagttcgcccgtgaacgtgtcgcggcccggccagtccgggatgcgcggggtgtggttgaagc

SEQ ID NO: 4074 - DNA, 610 bp, Unknown
  Kingdom: Bacteria, Phylum: Actinobacteria, Class: Actinobacteria, Order: Streptomycetales, Family: Streptomycetaceae, Genus: Streptomyces
accggccgccccaagggcgtcgtcgtgccgcacgccgcgctcaacgcctacctggcgtgggcgcgggtgcactacgacgcgggtgacggccgctggctggtccactccccggtctccttcgacctgacggtcaccgggctgttcgtcccgctcaccgcgggtggctgcgtccatctggtcgagctgggcgaaggcgcccccggcggcccgccgagtgtccgtcccacgctggtcaagggcacccccagccacataccggtcctcaccgaacttcccgaggagttctcgccgatgagctgctgacctccgacgccgtacgccagtggcgggcggcccggcccggtgtgaccgtggtcaacgagtacggaccgaccgagaccaccgtcggctgcaccgagttccgtgtgggacccgacgacgaactccccgaggccgccgtccccatcggccgtccctcctggaacaccgccctcctcgtcctggacgccgcgctgcgcccggtcgccccggggatcccgggtgaggtgtacatcagcggaacccatgtggcccgcggctatctgaaccggcccggactcaccgcgagccgcttcgtcgccgacccgttcgc

SEQ ID NO: 4075 - DNA, 2938 bp, Unknown
  Kingdom: Bacteria, Phylum: Actinobacteria, Class: Actinobacteria, Order: Streptomycetales, Family: Streptomycetaceae, Genus: Streptomyces
gaggggtccgtacgcggtcgcgtacggacccctccgtcttaccgttcgcccgcccccggcctccccgcgtggccggcgccgcgggactactgggcctcgggtcccgtggcgaccggccgggaggggtccgaggaccactcggaccaggagccggggtacaggacgccggtgaagcccgcgatctccagcgccagcacctcgtgcgcgccggagaccccggatccgcagtagacgcccacgccttcggagcttccctccgcccccaggccggcgaaccgctcggcgagccgctctgccggaagatagcgcccttcctcgtcgacgttcgacgtggtcggcgcggagacggccccgggaatgtggccgccgacgcggtcgatcggctccacatccccccggtagcgctccgccgcgcgcgcgtccagcagcagacccgagcgggcgaaggccgccgcactctccgcgtccagggtgggcagggatcccggcttcggttggaaatcgccctcgggagggcgcgggatcccggtggagaggtcgccggtccaggcggcgagtcctccgtccaggacccgtacgtcctggtgccccgcccagcgcagcagccaccaggcgcgcgccgcggcccagccctggccgccgtcgtacaccacgacaggggtgtcctggccgaccccggcccggcgcatgacggctccgaagtcctccgggtccgggagggggtggcggccgccgtcgcccgccggtcccgccagctccgtatcgaggtcgacgtagaccgcgccgggcaggtgaccggcctcgtagtcgggacggccgttcgggccgccgagctgccagcggacgtccaggagcaccggcggtcgcgacccggccgactcgctcgcgcattcggatgcggtgatgatgggcttcatgggtgccatcctcgcgcagcggcaccggcacccgtaaccgcatcggtaagggcggccggcgggaatccggccgtccttcgtcgagaacccggacgacgcggcgcggccggtgcgtctcccgcgccggggggtgcaagcatctgcacgggacacgcggaccgctgcccgacccgggacggcgtacctgtcccgtcccccgcacggccaccacaacggtccgaggagagaagacgatgaccgaggcctccgcccggcgcacgcccggaacaccttgctgggtgagtctgatcgtgcacggcctgaccacgacccaggagttctacggagccctgttcgactgggagttccggccgggtcccgaccagctgggcccctacgtccgcgggctgctgcacgggaaggaggtcgcgggcatcggccagctgccgcccgaccggcatctcccgatcgcctggaccacctacctcgccacggacgacgccgacaccaccgcggagaccatccgctcctgcggcggaacggtggcggtcggcccgctggacgcgggcgaggcagggcggctcgccatcgcctcggacccgagcggggcggtcttcggcatctggcagggctcggagcacatcggcaccatgacggcgggagtgcccggcacccccgtctggaacgagttggtgacccgggagacctcgatggtcgcgaagttctaccagacggtcttcggctatgagacggaggcggtcgtctcggccgacttcgactaccagaccctgcacctggacgacgttccggtggcggcgctgcacggggtcggtcatgcgctgccgcgcgaccgcgggccgcactggatgacgtacttcgaggtcgccgacaccgaccgggccgcggcccgggtggtggagctgggcgggcgcgtcctgcagccgccgcgcgagggatcgagcggtcggctggcgacggtcgcggacccggagggggccgtgttcacggtcatccggtccgccgggagcggctcgtccggccggtgaacgtcaggaatccggcccctccccggggccggccctcaggctgccgtgtgcagcggaaccgtcagctgcttgagccaggtgcccgtggagaagtcgcgggccttgatcacgaccgtgcgggggcccacctcgacctggaggccctggttgaaggcgccgcccaccgcgacctcgcctccccggccgtcgtccgtccagcccgtctggaccgccgcggtgttcacgacggtgaagccgtcgaggtttccggtgccggggacgaccctgcggaccacccagtcggacaggttgagatcccagtgggtgtggccggagaagaggaacacgtccttgtgacggccgaggatcgagagaagccggtcgggctggaggtagtcgcccagatagagcttgttgcgggtgcccgacacggtgttgggcagggggtggtgggtcatcaccatgacgggcttgcgccgtcgggcccagtgggcgagccggtcgtccagccaggcgaactgcgcgtcgctgatccacacctcgtcccacaacttcgcgtcgtggtagtgcgcgtagcgttcggtccccagggtcagtacgggaacgccgccgaacgacgcctccgagtagaccttgttccgtcccgcgaagttgtagaagctgcggaagagcgagtcctccgtggtgccgttgggccaggtgtcctgggcgagcgtgtccgggtcgctgtacttggggacgtagaactcgtggttgccgatggcccacgcgaggttctcggggtgctggtgccgacggagggtgcggcggacgtccgcgtactcgaagtcgtagcctcggggagtgatgtcgccggcgatccccagtccggcgctgcggggattgatccggtgcaggtcgtcgagggccttgccgaagtcggccaggtcgccctggatgtcgctgatgacgttgaagcgcaccgtccggcccccgccgcgccgctcgtcctcctcggcggccgcggccgatggggcc

SEQ ID NO: 4076 - DNA, 2599 bp, Unknown
  Kingdom: Bacteria, Phylum: Actinobacteria, Class: Actinobacteria, Order: Streptomycetales, Family: Streptomycetaceae, Genus: Streptomyces
  misc_feature (123)..(291): n is a, c, g, or t
tgctgatcctgctggcggtgggcgtctggttcgcgctgccgcatctctcgggcctgttcggcctcgccaaggaggagaccgggaccccggagtccatgccgcccgccgtctgccggggttccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggttcggacacggtcaaggcccggctcacggtcgagtcggcgtacggctcggggaaggaccggcggacggcggtcgcggagatcgagttcttcggaaggcgggagtgagacgggagtgagacgggggttctcgggaagcgggagtgcttcggaaggcggggtggacggtcgtacgggggaagcctgttacgggttcagccggtccgcgcgcctgcgcagatagcgggcctcgggttcgctgagcgtgccgtcggcggccgcgcggtaggcggcgcgggcggcgtccggttccccggcccgctccaggagatgcccgcgtacggcgtcgagccggtagtgacgctccaccgaccccgtcagggcgtcgaccgcggccagccccgcccggggcccgtgcaccatggccacggcgaccgcccggcccagcgcggcggcggggtcgggggtgcgccgcacgaggaggtcgtagagggcgaggatctgcggccagtcggtgtcctcggcacgctccgcctcgtcgtggagggcggcgacggcggcctggagctggtagtccccggccgggccctgggcgagcgcctcctcggccagcgcggtgccctccgcgatggccgtacggtcccagagcgcccggtcctgttcgtcgagcgggatcagctcgccgtccggcccggtgcgcgccggagtgcgcgcctcggtgaggaccatcagcgccagcagcccggtcacacgcccctcgtggggcagcagccggcggacggcgcgggtcagccggatcgcctcgcgcgccaggtccgtgcggtgcaggtcggggcccgccgtggcggtgtagccctcgttgaagatcaggtagaggacctggagcgcggcgccgagccgctggtcgaggtcctgggcgtccggccgccggaaccgcgtaccgcgcaccgcccgcttggccctgctgatccgctgcgccatcgtcgcctccggcaccagatgggcgcgggcgatttccgccgtggtgagaccgccgaccgcgcggagggtgagcgcgatctgggcggcgggggagagcgcggggtggcagcagaggaagagcagcgtgagcgtgtcgtcctcggagggcgcccggcccgtgccggagggaccttccccgggcggcggcgcgacgaacgcgtccgccggggtgagagccgccgccgtctcctcccgcctgcgacgggcctcgtcgctgcggagccggtcggtgaggcggcgggaggcgacccggatcagccagccgcgcggattgtcggggaccccgtcctgcggccactgctcggcggccgcgatcagggcctcctggacggagtcctcggccgggtcgaagtgcccgtaccggcgcacgagcgcgccgaggacctgcggcgcgtgccggcgcagcaggtcctcgatgatgacgtcggtcgtcgggtccatccgcgtcctcgggtgttacgtcagtcgtcgatcccgccgtcgacgggtcggatgaggaccgggtagtcgggcgccccggccggctgcggacagcgtgccacgcgggtcgcgatctcggtcaccctttccaggctctcgcagtcgagcacccagaacccggcgagcagctccttcgtctcgctgtacggcccgtccgagaccaccggacggccttcgccgtcgagactgacggcccggcccgaggcgggctcccgcagcccgtagccggtgaccagctcgcccgactcggcgaggtcgtcgttgatgctgcccatgtaggcgaacatctcctgcatggccttctcgtcccaggccgggctgtccgcgttccccttgccggtctgcgcgtcgtagtccgcctggctgccctggaccatcaccagatacttcatgaccgtcgcctcctggtcgctcgttcgctcgttcgctcggtggtgcttcttcctcctacacaggggacgtcggggccggcgcggggttctcgacaccacgcgcgaagttttttcggattcacccgctggagggggtggaacgcgaggttcagtaaagttcggcagcgttgcccccgccccccgccgattcctcctgctgcgccgaacgaggtcccgaccgtgtctgccgcccctgcccctgctgctcccctgcaccccgtctccgtcgtggggatcggcgcggacggctggtccggcctgtccggtacggcacgggaggcgctgtgcgcggcggaggtgctgatcggcggggtacgccagctggacctgctcccgccggagtgcgccggcgcccgcgtgggctggccgtccccgctgaggccggctgtcccccggc

SEQ ID NO: 4077 - DNA, 2190 bp, Unknown
  Kingdom: Bacteria, Phylum: Actinobacteria, Class: Actinobacteria, Order: Streptomycetales, Family: Streptomycetaceae, Genus: Streptomyces
gtccgcgacggcgtggccgaggccggtggccgtctccgcgtaccccaggaccaccgcgcggcgggcctcctgagcgccgagcagcgcccgcacccgctcacccagctcgaatccggccccgtggacgacggagggccgctggggcacgtgcttgcccagcacgttggacaccagcagatgcgcccgcttggggttgcggcgcagggccaggcccagcagttcccggagttctccgtcgccttcgagagcgactcccagccgctccgccacccagctgcccgaccacaccacgtccacggtctcttctctcgtcgcgcgctcgctcatcgatgcgcgctcagttcgtcaggccggcggccagcaggtccacgaagccgacgtcttccttcgccaccccgaagacctcggcccgctggagcgtccgctcggcccaggcccggtggggcttcacttcgttcatcttgttcgtgtacgccgagcgcagcacgccgccgcctccgcgctcggggctcaggatgtcctgggcgtcggtgaactcctcgtggctgaccacggacagtgcgtggaccggtgccacgtgcgacgggtggatgcaggtcttgccgagcagcccgttggcacggtcgagctcgatctcccggagcagtccgtcgaggtcgtgctcgatgagggccgtacgcagttcctcggcccggccctccaggaacgggctgcggcgcagcaggggcttgaacatgcgctcctggcgtcggaagtactcccagaccgggccggtgatcgtgaagccggtgccgtcggcccggccgagcacgttgaccacgtcggcgatcacggaggcgacgatatggacgtcgtacgccgtcatgtccggcgcgcggcgcaggccgtaggccgagcagaagtcggtgacgccgagccgcagggcgagcacccggtcccggtgtttgtcgacgctgcgggcgatgccctggaggatttcgccgcgcgtctccagatggagcagctcgggggattcgagtaccggcatcgcgaagagtcgtcgtccgcacgccgtctcggcctcggtgagcgcctccaggaaatgtcggccacgctcttcggtgaatttgggaagtacgaaaccggacaacatgcggacggagtcgccgaggcgccgaaccaggtcggtgatctgagccggctcccggacgcggatgaagagcagcggtacatcgtcgtccgccgcacccgtggcgtcctccggacttcgcgcggcggtccccgatgccgcgtcccgagcggccagcgcggcaaactgcctgatcagattggcttcggcgtcggtgacctcggcgtcgtcgatggagtcctccaggcacagcaccatggagacgacgccgcgcgctgcctgcttgagcacgtcgtcggcgagcgacggccgagtggccggggagtagagcgtggctcccagggcgacggagagcatccgtgccggggagtccgcggtgaaggtgcggggctccctgaagaacagaccctcgcgggcagtgggcgagatatgcccgaaatgacgcatgattttcccccgaactgcctgaccggccgaacaacgtatggccggtaatagtacgtacggacgggtgtcaacagttccccatgtacatgaatttccggttacccgcgccttgtccgaccccctctcggggtatcgtcgcgccctgccggcgccgccgccgggcacggtcgtgccgccccccgcgttgtccgcacgggcccccagcaggcaggatgacggtcatgacgcacacgatgctgaagggctcgaacgtccccgtcgatgccgcggccgtccgggccgtgctgcgctggaccccgggcgccggggtgcccgacgtggacgcctccgccctgctcctcggtgcgtccggccgggtgcggtccgacgaggacttcgtcttctacaaccagccccggcatccctccggcctggtccggcggctgccgaagcgcagtgtcccggaagggctgacggacacggtcgaggcggacctcggagcgctcgacgcctcggtggaccaggtggtcatcgcggcctcgtccgacggagccgccttcgaacaggtcctggatctgcggatactcctcttcgacgccgcgttcgccgagggcgagccgctggcggtgttcgatgtccggccggagaccggggaa

SEQ ID NO: 4078 - DNA, 2156 bp, Unknown
  Kingdom: Bacteria, Phylum: Actinobacteria, Class: Actinobacteria, Order: Streptomycetales, Family: Streptomycetaceae, Genus: Streptomyces
gacgtggcctacgacgacgtgaaggacgtcgtcgtcgcggcggccgtggtgctggacgccgtgaccctggagacggtcgacgaggccaccgccgtcggccggatcaccttcccgtacgtccccgggctgctggccttccgggagatcccgacggcgctggaggccctggaggggctgagcgtcgacccgggcctcgtcatctgcgacggctacggtctggcgcacccgcgccgcttcggactcgccagccacctgggcgtgctcaccggcctgccggtgatcggcgtcggcaagaacccgttcacgttcacgtacgaggcccccggcccccggcgcggcgacttctccccgctgctggacggcgaagaggaggtcggccgggcgctgcgcacccaggagaacaccaacccggtgttcgtctcggtgggccaccgcatcagcctcgacaacgcctgcgcccacacgctccgcctcgccggccgcttccgccagccggagagcacccgccgggcggacgccctgtgccggcagaccctccgggaagcgaccgcctgacccgggccctggggcgtcgcccctggtcttcccgaggccggtcaccgccgccgaggctcggcggcgcagcgcggccgacggccgcccggtcgtctactggcgtccgggctgcacgtcctgtctgcggctccgcctccggttgtgccgcgccgcctcccggctgcactgggccgacatccggcgcgaaccgggggagcggccgaggtgcgggcggccaacggcggcgacgagaccgtgcccgccgtcttcctggcggaccggccgcacaccagtacggacccgtcctgggtacgcgaacagttgccgtccgccgcgtgacggtcccgggcccggaacagtcctgcaactgagtacccgtacggatggcgtagatccgtacggctgggcaggctgatacgtatgaacgcctctcgtacagccgtccgcaccgagcccttcgaccccacgcagcgccgcatggccctcggcatgctcctcgggagcgccgtcggcctcgtctggctgggcgcgatgctctacacgctggccggctggatcttctagactccgcggtcggccccggctaccgcaccgccgccacccggaaccgcagccccgccgccgtcagccgttccaggagcgcgtcgcccatggccaccgccgtggtgacctgcccggaggtctccggaagctcgtccagggccaggcacaccgccgactcggcgaggatcttcgccgtctcgccgtaacccgggtcgccgccggacacctcggtgaagacgcgccgcccgccgccctcgccgacgaagcggatggtgaaccagctccgccgacggcgttcctcgtccggcccctgccccggcgcgtagcggctcatcagccactcccgggcaccctccacctgcgcggcggccaccagcgcaccgatcgccaccggggcgccgagagccatcggcagggacttgaccgaggcgaagtgccggtagcggaagtcggggccgtaccgctccagggaccgcgcggagcggcccacgatcgtcgggtccaccgtcggaagcggcagcgcccaggtgccgatggagccgctgaagtgcggggagcccgccggggtgcggacgcgccggcccaccaggcgcggttcgtgcagccggcgctcccgggcggcggccagcatccgcgggccccggcccatcgcggtcagtgccgaggcgaacgttccgccggagaacaccgcatcggtacggacgaagccgtcgacggtcaggggtacgtcctcgggcagctgcttgacggtgaagtacgcccccaggtcgtgggggacggagtcgaagccgcaggcgtgcacgatgcgcgcccccgtctcgcgggcccgtgcgtcgtgctccagatacgtccggtcgatgaactccgcctcgcccgtgaggtccgcgtagtccgtcccggcctccgcgcacgcggcgacgagcttctccccgtagcggatgtacggccccaccgtggtggccaccacccgggtggaggcggccagttcggccagtgcctccgcgtcgtccgcgtcggtctccagcagcggcaggtccgcgcagccgggccaagctggaggggctgcgcgaacggctcac

SEQ ID NO: 4079 - DNA, 1724 bp, Unknown
  Kingdom: Bacteria, Phylum: Actinobacteria, Class: Actinobacteria, Order: Streptomycetales, Family: Streptomycetaceae, Genus: Streptomyces
gccctcctggacggcctccagcgctccgggctcgccgccctcggccatccggaccgcgtacggggaccagcggcccggcagggagttgtcctcgcccagggccttcgccagctcgtcggtggtggagcggccgggtcgggccgccaacgtcacctcgggccgctcgttgtcggcctcgagaaggtcctcgatgcccgcccggccgccgcccagcgcgtcccagagggcggagacgatccagcgggggtgcgagtgcacgacggacaggtggtcctcggcgtcctcgtcgtacgagggggcgaccttctccacccagccgtcgaggtcgtgcgcggtgaccttgcgcagcaccgcgttgacgaacttcgcgcgtccctcccccagcaccacccgggccagctccacactggcggagacggccgcgtgggtggggatgcgggtgccgagcagctggtggacacccatgttcaggacgtcgaggaccggcgggtcgacctcgcgcagcggccggtcgatgcaggccgccacgatcgcgtcgtacgtgccctgccggcgcagcgtcccgtagaccagctcggtcgccagcgccgcgtcccggctgtcgaagtcgcctttggcgcgggccttcttcagcagcgggggcagcacgaggttggcgtacgcgtcacgctcgtcgacggcccggagcgcctcgaaggcgaggaaacggaccgggtccttctgcggacggcggtggggcttggcgggacggcgacgcggctggtcgttcacgtgaaaggtgctccgctgatggtgagaggggcgaaccctcccagcgtacgtcgccgtccgtgggcgcccgaacggcagccctgggccccggaacgccgccggggggcccggaccgtccctgccgctcggagcgcctctctacagaccgagcagctcgccgtggacgatgcggacgccgcgcgcccagtcggcgcccttcatcggcttcttgccctgcggctggacccagagcagctcgatcgcgtgcgacccggtgcccacgtacacgttgttcttggcggccgacagctcgccgggggccaggtcggtgcggtccaggaccggcacggcctggatcagcttgagccgctcgccgcggaacagggtccaggcgccgggggccggggtgcagccgcggaccacccggtcgacccgcagggcgggtgcggaccactggacctgggcgtcctcgacggtgatcttcggggccagggtgacgccgtcatggggctggggcacggcgtgcagcgtgccgtcctcgatgccgtccatggtcgcggcgagcagcccggcgccggcgaaggcgagccgggtgagcaggtcgccgctggtgtcgatggggcggacctcctcggtgaggacgccgtagaccgggccggagtccaggccctcctcgatcaggaaggtcgacgcgccggtcacctcgtccccggccatcaccgcgtgctggaccggcgccgcgccccgccaggcgggcagcagcgagaagtgcaggttgacccagccccgggccggcacatcaagggcgaccttgggcagcagggcgccgtaggcgacgaccgggcagcagtccggggcgatctcgcgcagccgggcgaggaactcctcgtcgcgagcccggtggccgagcgggcggaggaggccgggatcgaggtgctcaagcccgccaggccccgcgacgaggagttcctcgc

SEQ ID NO: 4080 - DNA, 1985 bp, Unknown
  Kingdom: Bacteria, Phylum: Actinobacteria, Class: Actinobacteria, Order: Streptomycetales, Family: Streptomycetaceae, Genus: Streptomyces
tggtgcggccccgccgccacgcgcatcgccctctcggcgcgcgtggcggcggggccgcaccaccagccggtctcctggacctggtactccaccgacaggacgtgctcgccccgggcgtgcacctctttggtgcgcagcaccgggaacgcgctgcggtacccgcggacttcctcggtggcgacctggatgccacgggagtgtgcgcggctcgggggaagcggggctatgtgcaggccgtccgggcggggtgcggcctgtgcgccgccggtggagagtgcgacgcctgccgcggtgagcgccgtcgcgctgaggaagcttcttctgagcatcggaatcggtcccttctcggtggggggatgtactgatggaaagccgcggtccgtgttgtgtgggggtgagcgctgagggtcagaccccgagaccggtgaggagcagggccagtccggcccgtacaccacgacgcatcgtcgcctcctgatgcagtggggaacggagagaaacgcacccgggctcgcgccgaggacggcgacccgggttcttgcgctgtcgtcgcttctacgcggcggagcggccgtccagttccttcgcgcgttcgatcaaggcacgggccacgccttccacggcgtcgtagcggtcggggtaggccgagacctggacggcctgcgccacctgtcccgcggtcatgcccgggttgttcgccgccaccctgatcgcggaggtgaagaaggcgttcgacgcgtatgacacgtccatgatctgttccggcgtgccccagccctgcgacgggcgctgctggaagacgccgagtgaatcccggtcgccgcagtccaggttgttcatcttcgactcgaccacgcccgcctcgaagccggccagcagtacccggtcgtcgacgccgaggtcgacggccgtacggtagacgaccttcagcacctcggggtcggggtcgctcggtaccgtgcagcccccgccgccgttgccgccgcccgtgccgatgaggtgctgccaggtctgcgggccgatgatgccgtccggggtcaggccctgggcgctctggaacgccttggtcgccgccgtggtggccgggccgaactgtccttccacggacagtccgtgaccgtgcttgttcaacgcggtctgcgcggccgacaccgcgtcaccgctgtgcccctcgctgaccgtgacgatcaggcccggccaggtctccgcgccgatcacaccgtccgcgccgtaccccctggacgcctggaaagccacggtggcgccctcggtcgcggggccgaactcgccgtcggtggcgatgtcgtggccgtggccgcgcagcaggtactgaacagtgctgacgtcggggcccgatgaaccggtgctgaggaccggccagcccggagcggccgttgccggttgcgcgagcccgaaggagaccatcagtgcggcgcacaccgctgccagcgtgacccacgcccgactgattcgtgttccggatatcaacgcggctcccatcattccagggcatcgaggggccttggagcgccgaaaggtagcaaccggcgggtagaacggcatcgggtgttcgaccgacgtacgagaggtgacatgtccgccgtgtcgcttccacaccggccacgcgccgaccgcccggcccctcgtccggtccggtggcgggcacgcgctcgaccgaagccgtccgccgaacggcttcggtatagtccgcgacgccgggttccctttccccgtaagcgagttggtccgctcgaccaggaagatcggtgtcccgatgcctcgtccgtcgctcctcggtgacgccttggtggtccgctcgtcctgtccgtccggccgcccggaggacaaggtccgcggcatggccccccggcccggccggtgagaggcgcgctttcggtcccgccgcacgacggcgtcgaggagcgcttcgtggcggccgcacggcggctggccccgcccgtgcggccgccacgaagcgctcctcg

SEQ ID NO: 4081 - DNA, 712 bp, Unknown
  Kingdom: Bacteria, Phylum: Actinobacteria, Class: Actinobacteria, Order: Streptomycetales, Family: Streptomycetaceae, Genus: Streptomyces
gctcggggccgccgaacgccgggcgctgcgctccgcgatggcccggctccccggacgctgccaccggctgctggaggcgatgctcgcccccagcgacccgacctaccgggaaatcgcaggggagttgggtatgtcacaggggagcttgggcccgatccgttcccgttgccttggatgtctgcgcagaatgctggctgcggaggttgtcgctccttccgtgcgggaaaggagcggtaggcaaccggcgaacaggtgagcgggaggcgtgcacacatgggcatgagcgtgaccatctcggcggcgacggcacaggacgtcgagcagatcttcagacttcagtacctctgcttccagcgcgaggcggagctgtacgacaactaccggatcgacccgctcgtccagaccctcgaatcgctgcgcgccgaagtcgccgacgacctggtgttcgtggcccggctcggggacgaagtcgtcggctcggtccgaggattcaccgacccggacggcacgggtctcatcggcaagctctgcgtccacccccggctccagggccacggcctcggagccaggctgctgctctccgccgagtcggcgctctccgcggagcgggcggcgacccgcttccggctgcacagcggacaccgcagcgagggcaatctacggctctaccggcgggccggatacgcccaggtcggtgccgtcaccggagccg

SEQ ID NO: 4082 - DNA, 1023 bp, Unknown
  Kingdom: Bacteria, Phylum: Actinobacteria, Class: Actinobacteria, Order: Streptomycetales, Family: Streptomycetaceae, Genus: Streptomyces
cagtagacgcctcggccctgtgcggaagaccagggccgaggcgtctactggccctgttcgtcgcggcggcgctgccaccgctgctcgatgcggttcatcatcgaccggcgttgtctcggtcggcggcctgcgccgctgtccccgctgcctgcggcagccggctgttgttcaccgggcttgggcgccttgcgccatccggtgaccgcgagcacggcacagccgagcatgacgaggaaccccaccacgctgatccagatctgctgggcgaccattccggccatgaggagcgcgatacccaccaggaagccagcgaccgcctggtagacccttcgtcgggtgtacgtacgcagtccgcttccctcgagcgctgtcgcgaacttgggatcttcggcgtacagcgctcgctccatctgctcgagcatgcgctgctcgtgctccgagagcggcacgggatcctcctcgtcgtcggccgcgggggcgaccggtatgcggcccttccaggataggcagggattcgcccccgtgaaacccgccctctagcgctcagccagtccggaccgctatgtcggctcggctgctgaggcgtagattccccgacgaccgatccgccatgccggatggtgtcacccgatcatacggggcgtacgccccgtacgggggtcctgagtcccactccgtccgcagctgcgttgctgatcagcggcgcttctcgcccagaacgtggagctgggtggcgacggagtggaaagcgggctgctcggcgacggccgcttcgagcttgaggagtgcctccaaggcgccgggctcggtgtccaccagggcgcccggcacgaggtcggcgaagacccggaccccgtgcaccgcggcgatctccagaccggccgtggagaccaggtcggagagctgctcggcggtgaacctgcggggcaccgggtcgccctcgccccagcggccggccgggtcggtgagcgcctgccgggcctcggtgaagtggccggcgagcgcgcgggccaggacggctcc

SEQ ID NO: 4083 - DNA, 2660 bp, Unknown
  Kingdom: Bacteria, Phylum: Actinobacteria, Class: Actinobacteria, Order: Streptomycetales, Family: Streptomycetaceae, Genus: Streptomyces
  misc_feature (2226)..(2227): n is a, c, g, or t
gaccgcgcgccgggtccaggaggtgcgctgcgcttcatcggtgctgtgcgcccagtagagctgggccgccgcacggacggcgggctcgtggcgcagcagtcccgcgttcgcgtgcaggcgcagcagggccgccaggatcgcggtggcgtcctcgtcgtggacaccccgcgtgtacccctcgtcgtaggcctcggcggcagactcccgtacgagcgaggccaggtcggctccggtgagcgcggcgaggcggctcgccccgtgctcgtcgagcagccgtccggcgaggtgctcggcacggtagacggaggcgttctcggaggggagcagctgctcccagtacggccgggcagccgcgaacgccgggtcggtgaccggggcccggtagtccgtcccggtcagcgcgaaggcgaggctctctccggcgggcacgagcgtcaggtcgaacggctgggtgttgacggcgaaccggtggcggcccagcttgatcacggacccgccgtccgcgtacagctcggtgcggtcgcgcagggcgcggccagcctcctggcgggccgccctcagccgtccgtccagctcttccgcccgtacggaatcgccgagttcgcgcagttcaccggcggtgcggcggaccttggcgaccatcgggtcggaggcgaagtaggtgtggacggcgtcgaggtcctccagcgaggccacccgccgggcgatggtctccagcacccggcccgcggacccggccagccgctccgcgcgccgggcccgctcgtcctggagggcctgcttgcgcgccgagaacgcctcgtacacctcggtgcggcgctcggacagctcggagaggaagtcgtcgaattccgcgaaccgcgactccaggttctccaaccggatcagcagtcgcgccagttggtggtcgcatgtctccggtgtgccggcggcggccagcgcgcccgtgacggcctgcccgagcagcgcgaactcggcggcgaactcggcccgcccctccttcgacagcagctcccggcggcgcgcgtcgagcgtggcgcgggcccggttggccccgcccagcacctcggcgattcgctccaggatcgaggtgcgcacggtggcgtcgccgatctccaggccggcgaccacgtccgtgacggtggccagtccctccgtcatcgcggacagccggtcggtcacggcggaggcgtcccggacggtctccagcgcaccggcgtccgcgacgagctccgcgatgtcctcgtggtatccgtcgaaggcatcgtcacgggcgaggaacgacacggcccgctgagcaccggacgcgatgtcgtcctcggtccgggcggacagttccgcgatccgctcgacgtccgcgtaccgcatcccgccgaccgtcgccaagtggccgtgtgcctgtcgcagttcggccagccgctcgacccaggcggacgccgacccgggcacctcgccgcgtacccggcgcaccagcgcggtgatccgggcggcggtctcctccagtgcgtcggcggcccgccgggtctgctcctgtacggcggtgaactcggccagcacctgctgcgcggtggcccgcagctcacccaacggctcgtccagcgaccccagttcgggatcggcaagccagtggtaccggtcctgggcgcgggcgcagtcggcggcgagctgcctgtacacggcggtcgtcggcgtcatgtcccgtacgccgtgggcaagggcgaggcagtcggagatcccgcgcaccaggtcggcgttgccggtccgggcgagcgggccggttccggcggggagggcggcggcgtaggtgtcggagacgtacggggtctgccagcgctgcaaggggtgcacgcgcgcgggcccgtccggactgtcccggaggaggatgagcgttccgtcgtccagcagcgcgtgtccgcgcccggtgagcggggtggcgacctcctggcggatcaggttgtaggggaggaggaggctgcggaggccgtcgcgggagcggaagacgtagagcacgtcctcgccgttgggtgagcggaccgcgccttcgaagaccggctcggtcagctcctcggcggtgtcgaaggtcttcgcggcgccggtggtgaggtagtagccgccggggaagatgatcccctggtcctcgggcagccggtggcacgccggcccgatgccgtcgagccgctggacggtcgagagcagcgagttgaagacgaggtgccgccaggcctnnccagcggcccggcctccgcgtacgcgacgtcggcgtcggccagcgactgcaacggctcgtcgacgggctcctcgtagatcccgtccggggactcggtgtcgtcggtgaccttgacggtgagggtgccgcctagcgtgtcgacgaagagtccgccgctcttgccgacggcgatgtgcgggtgccgccccgggacgtgcgcctcccgccccgtcgcggtccacgcgaagtcgtgggagggcgggaagacgtggtcgcgcccgccctgcgcgtcgaggaacggtcccggcgacccgtccggtcccagcgcccagcgcagcacccggatgtcctcggcgttctccccggtccggaagacggcgaggagcctgccgtcgacgcggcgcagccgcagcaggcgggcgtcgcggaagtagcggtggagggaggagaactc

SEQ ID NO: 4084 - DNA, 909 bp, Unknown
  Kingdom: Bacteria, Phylum: Actinobacteria, Class: Actinobacteria, Order: Streptomycetales, Family: Streptomycetaceae, Genus: Streptomyces
ggcagcggtgcgcgtcgaagccgacgacgatgccctcgccgtcgtaggagcgggcggcgggacgcgggggtggctggctggtcaccgctgactctcctgatcggctcggcatcctgacctcttcagcctcgctccgccgccgccgcgccgctactcggacgccgcctcacggcaggaccgcgaccccgtcgatctcgaccatggcctgctcgtcccagagccgggcgacgccgatgacggccatcgccgggtagtcgcgccccgcgagcctgcgccagatccggcccagctcggccgcgtgggaccggtagtcggcgatgtccgtggcgtagacggtgacccgggcgaggtcggcgggggcgccaccggccgcgtggagcgcggtgagcagattgcccagtgccgcggcgaactggtcgggcagggtggccccgacgaccttgccgtccgggtcgagcgcggtctgcccggcgaggaagaccaggtgcccgccggtggcgacgaccgcgtggctgaagccggtgggcggggagagttcggccgggttgatccggtgggacggactcatgcgggcggctcctgggtgaggtcccccggctccacggcctcctgggcggcggactgccgggcgagggactgctggctggtgggctgctgcgcggcggactgctgggcgaggggttcggaccgctgggcgccgtgcgcgtacagctccttggcgatgagggtgcgctgcacctcgctcgcaccctcgtagatccgcggcgcgcggacctcgcggtagaggtgttcgagcagatgtccccggcgcagggcgcgggcgccgtgcagttggacggcggcgtcgacgacgtactgcgcggtctcggtggcgtacagcttggccatcgccgcgcggcgcggcacgcc

SEQ ID NO: 4085 - DNA, 2340 bp, Unknown
  Kingdom: Bacteria, Phylum: Actinobacteria, Class: Actinobacteria, Order: Streptomycetales, Family: Streptomycetaceae, Genus: Streptomyces
ggttactgccgtggcggcagcggtggccgccgcaggttcggggccgtgtcgtacgacggcggtgtcgccgccgggtgcgcggccagcaggtccagggccaggcggaccgcgtcgtccaggacggcgtaccggccctccgcccagtccagtggggtgcgcagggcctccacgtccggttccacgccgtggttctccaccgaccagccgtacgtgtcgaaccaggccgcgttcatcgggaccgtgatcaccgtgccgtcccccagccggtggcggccggtcatgccgaccacgccgccccaggtgcgctggcccaccaccgggcccagcttcagcagccggaacgcggcggtgatcatgtcgccgtcggaggaggtcgcctcgtcggccagggcgacgaccgggccgcgcggtgcgttggaggcgtagctcaccgcctgggcgttgcgcgtcaggtcccagccgaggatcgtgcgggtgagcttctccacgaccaactcgctgatgtggccgcctgcgttgccccgtacgtccacgatcagggcgggacgggagacttcgagacgcaggtcgcggttgaactgggcccagcccgagccgcccatgtccgggatgtgcaggtaaccgcacttgccgccgctcaactcccgtacgacgtcacggcgtttggccacccagtcctggtagcgcagcgggcgttcgtcgaccaggggcatgatcgccacccggcgggaggggccgccgcccgccggggagaaggtcagctcgacggttgtgcctcccgccgccgtcagcagggggtacgggccggcgaccgggtccaccgggcggccgtcgacatgggtgaggaccgcgccctcccggattcccgtacccgccagcggcgaacgcgccttggagtccgaggaatcgccgggcaggatgcgctgcacggtccaggcgccgtcccggcagaccaggttggcgcccagaaggccgatcgcacgctggtagtgcggcgggccctcgttgcgccgggcgggggagacgtacgcgtgcgaggtgccgagctcgcccagtacctcgcgcagcaggtccgcgaactcgtcgggcgaagcgacccgttcgaccagggggcggtactggtccagcaccccgtcccagtcgatgccgcacatgtccggctcccagaagtaggagcggatgatccgtcccgcctcgccgtacgcctgccgccactccgcgcccgggtcgacctcgtgcaggatgcggcgcaggtccaggtagaccgtggagtcggtgtcgccgggctcggtggccggtacggcgcggagttcgccgtcgtccatcacgacgaggcgggacgcgtcgccgctgaccgcgaaccagtcgaggtggtcgaccagttcggtcctgcgggccttcgcgatgttgaagtgctccagggtcggccgccccgacatgtcggccgggttcgcgaacgtctcgcccagcgcccccgagatcggccagcgcagccagacgagaccgccgccgctcaccggggcgagggccgagtacttggaggcggagaccgggaacggcgtcacccggctctccaggccctcgaactccaccatcaccgtcgaaccctccgacgtacccccttcggacacgtccaccgggtccaggccgcccgccgccggacgcccgtccggggagagcgcgaagggggagggcgtcgccgaggagagcgggaccaggtacgggcggcagccgagcgggaaggacaggtcgccggtgtggacgtcgtacaccgggtcgaatccccgccaggacaggaacgccagatagcggccgtcctccgtgaagaccgggttctcgtcctcgaagcggccgttggtgacgtccacgatcaccggggcgccgggacccgagatccgggccagcttgatctgccgcagcgagcggccgatgcccgggtgcgaccaggtcagccagtcgccgtcgggggagaaggcgaggtcgcgcacgggcccgttgaccgagcggatcagctcggtgagcccggggtgctcgtcgaccggcaccgcgctgtccggggcagccgcgcccgtggccgtgtggaggtcggcgcgggtcgagccgctgggtgccttctcctcggtctccggaccctccacatccggttccagtagctccgcctccccttcccccgtgtccaggagcagcagacggccgtcgttcgacgcgatggcgagacgctcgccgtccgggtcggagatcatctcctggacccggcccagcagcccggaggccagcctgcgcggggggcggtcgccgctggcgcgcggcagataggcgatctcgaccgcgtcgggaccg

SEQ ID NO: 4086 - DNA, 1460 bp, Unknown
  Kingdom: Bacteria, Phylum: Actinobacteria, Class: Actinobacteria, Order: Streptomycetales, Family: Streptomycetaceae, Genus: Streptomyces
cggcgcgcagctcctcccggctggccgaacgtttcgacgacgaccggccgctcgatcaggccggctggcacgaggtgcagctcgtcgcccacacgctcgtcccgctgggtgccgccgagctgcgctactgctcgcccactccgcgcagccgtgccaccggggacgccctcggcttcgcgccgatggcgcaaccggccctgcgcgactgggacatgggccgctggcgggggctgaccctgggcgaggtcactgccttggaaccggccgccgtggaccactggctcgcggacccgcgcagcgccccgcacggcggcgagtcgatgctcggcttcatcgggcgggtgggcggctggctggacacccgccccgccgtcgacggcctcgtcgtcgcggtcgccgaacccgccgtgatccgggccgccctcgtctacgccctgaacgccccgccgtccgcgtactggaacgtcgacgtccgccccctgtccaccatcacgctgaccggcctcccgggccgctggagcctgagcctggaggcgggcatccgctgacccgggcggggccgggggactccgggactcctggggtgccggcccttccctccggtccgaccggtcggtacgttgcggggggcatccggtccgccgccggacgcgcgcccgcgacgagggaggtcccgtgccgcagatccacggccactgcgacgaccggttcaccggagtccgggacgccttcgaggagaacttcacggagcgcggtgaactgggcgcggcggtgaccgtcctggtcgacgggaaaccggtggtggacctctggggcggctgggccgacgcggcccgcacccgcccctgggaacgggacaccgtggtcaacgtctggtccaccggcaagggcccgaccgcactctgcgcccatgtcctggccgaccggggcctgctcgacctggacgccccggtcgccgcccactggccggagttcgccgcgaacggcaaggaatccgtcctcgtacgccacctcctctcgcaccgttccggagtggccgggcccgacaccccactcaccctggacgagctgtacgactgggagacggcctgcgcccggctcgccgccaccaccccctggtgggagccgggcacccgctccggctaccacgcgatcagttacggattcctcgtcggcgaagtggtccgccgcatcaccgggctgctgcccggcgcgttcctccggcaggagatcaccggcccgctgggcatcgacttcaccttcggcctcccggagagcgagacccaccggctcgccgaactcgtccaggaacgttccgaccgggccgcccaggcagccctcctggaccggatgacaccggtcgccgtcgcctccctgctgaacccgcccaccggccgggccgccgcgaacacgcgcgcctggcgggcggcggagatccccgctgccaacggccacggcac

SEQ ID NO: 4087 - DNA, 3144 bp, Unknown
  Kingdom: Bacteria, Phylum: Actinobacteria, Class: Actinobacteria, Order: Streptomycetales, Family: Streptomycetaceae, Genus: Streptomyces
ccgttcccgatccagggcgcgaccctgcccaacaccctcgggggccgcgacgtcctcggacgcgggcgcaccggctcgggcaagaccctcgccttcggcctggccctgctggcccgcaccgccggacagcgcgccgaggccggtcagccgctggccctgatcctcgtaccgacgcgtgagctggcccagcaggtgaccgacgctctcactccctacgcccgctcggtcaggctgcgtctgaccaccgtcgtcggcggaatgccgatcggcaggcaggtcaacgcactgcgccggggcgccgaagtcgtcgtcgcgacgccggggcgtctcaaggacctcatcgaccggggcgactgtcgcctgaaccaggtcgcgatcaccgtcctggacgaggccgaccagatggccgacatgggcttcatgccccaggtcaccgcgctcctggaccaggtgcgccccgagggccagcggatgttgttctccgccaccctcgaccgcaacgtcgatctcctggtccgccgctacctcactgacccggtggtccactccgtcgacccgtccgcaggcgcggtcaccacgatggagcaccacgtcctgcacgtccagggcgccgacaagcaccggacgacgacccggatcgcggcgcgcgaaggcagggtgatcatgttcctggacaccaagcacgccgtcgaccggctgacgcaggaactgctgaacagcggggtacgggccgctgccctgcacggcgggaagtcgcagccgcagcgcacccggaccctggcccagttcaagaccggccacgtcaccgtgctcgtcgcgacgaacgtcgcggcacgcggcatccacgtcgacaacctcgacctcgtcgtcaacgtcgacccgccgaccgaccacaaggactacctgcaccgcggcggccgtaccgcccgcgccggggagtccggcagcgtcgtcaccctggtcaccccgaaccagcgccgcgacatgacccgactcatggccgccgcgggcatcgttccccggaccaccccggtccactccggggaagaggcgctcagcctgatcaccggcgcccggacaccctccggcatccccgtgacgatcaccgcgccggtggccgcgcggcgtgagcgcagccgcagcaccggctcccgcggccggcgcagcccggcctcggccgcacggcgcgtgggcgcacagcagtccgcattcgacgcggcagcctagggccttccgtcacaccgccgtctgccggccggctgctcgtcgtcgtaccggtcatcgacgagcacggcagggcgccggccggcctcgctccggcccgctgaaccgtctcaccgccacagcaccctcccccttccactccctgtgaggcatcatgcgctgtgtcatcgcccgcttcccgttcgacctcaccaagagcggtgtcctggaaaccatgaagggcgtcaagcccgaacaggtcatcggcgcgtccgtgatcatcggtcgtcgcacctacccgatcaagcaggtcggacaggtcatcacccgtcaggaccgccgcgacttcagcgccggtgaagtcctccgggccatgacgcggctcggcttcacctgccccggcctcccgcgcgacgccgcgcccaagcgcgccgtcggcgcgttccgacaggcttccaccctgctcggcgcccctgccgccgtctgaccggcgggcaggcgtgagccgccaccaggacaaccgtgcgcccgccgccaaaaaatagtgcgagcccgaccggcagccgccggccgggctctcgccgcgtaccgagggtcagtcagcgcgcggcggtgtgctttcagtggtcggagtagctgaagtcgcccatggtccaggcgctgacgtcgtcgatcgccacgcggtacatcccgcccgtctccgggatccccaccgtgccctgcagaatccgcgccacatggaagtgcagatgcgtaggcgtcttctccacgggcgcgggggcggtgaagacggcggagaattcgctcagacgggccgaatcggccagcacctccgacacccgttgcctccagaccgcttcgggagccagccgcccggtgatgacagcaccaccggcgaccacggtcagagtcatctgattgctgtgcccggactccaccagagcagcgatatcaacaagcagttcgtcaggcttcgacatgggccaattttatgcaccgccgtccggccggttcgaggggtgtgccattaccggcggcaacatgccgggttcagcgcacctcggcctcgcgcggggggagtccggcgcaggcggggcagccgtgccggtcgatcgcggtcagcaggcgcgtggcagccgcgcgtacggcccgcgccggggaaggccccccggcctcgggcgtgtcgggtgcggcggccagccgggcggccgtggcgcggcccgccgccaccgcgtcgtgcgcggcgcgggtccacgccgggtgctcggcgtttccggcggccaggatcgtggcgagcaggcccaggacgcccgcccggtccctgaccgtgtccgtcgccgccagctcccagaggaacggcaccgtcgccgccgtcgagtcgaagacgggcggggtgccgatccagcgctccagatcgctcagcgcctcgtccgaggtcggcgcgtccccccacgcgatccgtgacagcacgccgggaacctgagaggcggagccgtacgcgtgctgcagctcgtgccaccgcacgttcctcatggcccccaggacagtccccatccgggcactcaatcagcctttaccgcacggcgtccaccatgccgggggaccgttccgcggaccggcccgttccgtggagccggcgcaggtactcccgtacggagcgggcgtcgtccgccggggcgagaacgcccacgtggtggtcgggtcggacgaccacgacggtgcccgcgcccgtacgaccggaggcctccgttccgtacgcggcggccgcgtggcccgcgtcgtcgaccaccgctcccggctccgcccccgcccggtccccgtgcgccgcgtacacccggcagatccgcacgccggcgtcgccgccgtacgtgtccgccgtctcgcgcaggaccgccgcgcacccggggccgaagccgaggaccgtggtgcgggggccggcga

SEQ ID NO: 4088 - DNA, 1644 bp, Unknown
  Kingdom: Bacteria, Phylum: Actinobacteria, Class: Actinobacteria, Order: Streptomycetales, Family: Streptomycetaceae, Genus: Streptomyces
cgccctgcccctgaccgggcgccgggcatgaatccgtccggcgtccgggccctcggagccctcggggccctcggggctcctcgtggcgaaggcctgcgagatgtgcacggggcaccgtcctgtcgttctgcggcgtgcggtcggccgttcgccggtagcggcgtgaccggaggggttccggcccggactgggaataccttaggttagccttacctgagtatccagtcctcggaggggccccatgctgtcgtccagatccgcccgcgcgctcgccgtcgcgctcctcgcggtactgctgggagccctgctccccgccgccaccgcgcaagcggcaagccgtacggtgcagggcggccgactggactggggcatcaagtcctccttccagagctacgtcaccggccccatcgcgagcggcagttggagcctcaccggcggcgcggccacggtcggcggcagccagttccgcttccactcggcgaccggctcctacgacccggacaccggagcgctcagctccggcttctccggcggcgtgcacttcaccggccatcggaagcccgacggcagcaacgagctggacctcacgatcagccgtcccaccgtccggatcagcggcggcagcggcacgctccacgcggacatggtcagcaaggagcgggggaccgggaaggtctcccaccgctcccaggtgccgctggcctcgctcgacctcggcgggatcgacatgaagggcggttccacccccgtcgccctcaccggcgtccccgcgacgctgacctcccagggcgcctccgccttcgccggctactacacggcgggcaccccgctcgacccgatcagcctctccgtcgacaccaggggcgcggccgccgagccgaagccgtccgtcccggacgagaagaaggacgagggcgggaagaaggacaaggagaaggcggcgaagaaggagaagacgggccgcttcgaggacgccgccgtcgactggggtgtacgccgcaccttccgcgagtacgtcaccggctccatcggccagggcaagtggacactcgccgacggcgcccaggacggcggagcgctgttccgcttcccgcggggcaaggggacgtacgacgcgaagaagcagacgctggacgcggacttcagcggcagcatccgcttcaccggcgcccatgacctcgacctgaagttcggcggcgtcaccgtcgccgtcgcccagggtgagggcaccctgtcggcggacgtcacgagcgagggcgccacccgcgaggacgtccccctcatcaccttccccgcgaaggacctcgcaccgaaggagggcctcgccgtcctcaccgaggtccccgccaccctcacggccgacggcgccaaggcgttcggctccatgtaccgggcgggcaccgcgatggacccggtctcgctcgccgtggccgtcgacgacaaggcccgactgcccgcgctgccggatctcggcagtgagccgacagcggacgccgagcccaagaagaaggccgcggagaaggcctccgccgcacccgtggccgcctcctccgactccggtcccgggacgggcgtctacctcgccgccggcggcgcactgctgctcgtcgcggccggagcggcgttcttcgccctgcgccgccg

SEQ ID NO: 4089 - DNA, 4065 bp, Unknown
  Kingdom: Bacteria, Phylum: Actinobacteria, Class: Actinobacteria, Order: Streptomycetales, Family: Streptomycetaceae, Genus: Streptomyces
  misc_feature (3797)..(3798): n is a, c, g, or t
ggagggcggcgcagaccgcgtccgcctcgccccggccgcgcggcaccgttccgtcggtcaggtaggccgccaggtgcccgtccaggcagtcgttgccgctcagcgtgatgccgtggttgccgccgccctcctccacgacgaggctggagcccttcagcttgcggtgcatgctgaccgcgccgccgtacggggtcgccgcgtcgtccgtggcctggaggatgagcgccgggggcagctgacggttgttcacccggaccggctccagcgggcccaccggccagctcgcgcacggcgcgttgtaccaggtgttgttccaggtcatgaacggcgccttcttgtggatccggcggctgtcgttgcgccaggtgctccagtgctcgggccaggcggcgtcgcggcactggacggccgtgtagaccgagtacccgttgtcgccgctcgcgtcgaccgcgccgaagttctcgtacacctcgaccagcgcctcggcgtcccggttcttcacgtaagcggcgaacgcctcggcgaggtagggccagtagccgttgtagtacccgccggggatgaaggtgtcctccagctcgctcgcgccgaccgtgccgtcggccggctcccgcgccagggccgcccgcatccggtaccaggcggcctccacctcggccgggtccgtgcccaggccgtacgcggcctcgttcttcgcgacccaggcggcgaaggccttgtggcggtcgtcgaacggctggtcctggccgaggttgccctcgtaccagacgtcgtccgggtcgacgaccgagtccaggaccaggcggcgtacgcgctccgggtacagcttggcgtagaccgcgccgaggtaggtgccgtaggagtagccgaagtagttgatctgccgggagcccagcgcccggcggatcacgtcgaggtccttcgcggcgctgacggtgtccatgtacggcagcacgtcgccgtgcttctcgccgcaggcccgggcgaaggactccgcccggtcgcggttgatccgctccgagcgggaggagtccggcaccgtgtcgggtcgcaccggatcgaagtgtccgggcaggcagtccagggccggggtgctctttccgacgccgcgcgggtcgaagccgatcacgtcgtactgcgcggcgaccttcttcggcagcgaggacgccacgaacccggccatcgacaggccgctgccgccggggccgcccgggttgaccagcagcggaccctggaaggtcttcgcggtgtgcgggacgcgggacagggcgagcgtgatctgacggcccgacgggcggcggtggtccagcggtgcgcggaccttcgcgcactggagcgtcgggtagctgtcggtcggacagtcggtccacttcggcttcggaacgggcggcgtgctcgccgcggtggtggcggccggcgcgggcgcggcggtcagcagacctgcgacggtcgcaccgacggcgaccaggattcctgcacgtttcgtcatggggcctcccggggtgacgggacccggcgcgggatcaccggtccccgccgcatgctccccgaatacgcccgcggaaggacctgttccgcgcggagtcggcccgtacggtcacgccatcggccctgcgggcggtctcccggactccgccgcgggcctcacagcagggtcagctgggtggggccctgctccggtgcggtggccggagcagggccgatccgccgggcctcgccccggtgcgccgggccgatcccgaactcgtccgccagctcgtgcacctgacgcgtgatccggcgttggtaccaggtgggggcgtacgccccgtccgcgtacatccgctcgtagcgcggcaccagatgcggatggtgctgtcccagccagtgcaggtaccactcgcgcgcgccggggcgcagatgcagcaccagcggggtcaccgaggtggcccccgcgtccgcgacggcggcgacggtggcgcgcagttggtccgggcggtcgccgaggaacgggatgaccggggccatcaggaccgagcagccgatccccgcgtcggtgagcgcgcgcaccacgtccagccggcgttcgggggagggggtgcccggctcgaccgtccgccacagctcccggtcggtgaagccgacggagaccgagacgccgatctcggcgacctccgcggcctgccgcagcagttccaggtcccgcaggatcagcgtgcccttggtgaggatggagaaggggttcgcccggtcgcgcagggcggtgatgatgcccggcatgagccggtatcgtccctccgccctctggtaacagtcgacgttcgtgcccatggcgatgtgctcgccccgccagtgccgggacgcaagctcccgctggagcagttcggcggcgttgaccttgacgacgatctgggagtcgaagccgataccggtgtccaggtccagatagctgtgggtcttgcgggcgaagcagtacacgcaggcgtgcgtgcagccccggtacgggttcaccgtccattcgaacggcatccgcgaggcccccggcacccggttcaggatcgaccgggcccggatctcgtggaaggtgatgccccggaattccggggtgtcgaacgtgcgcgtggtcaccgcgtccgcggcgaagagcgcgctgtccccggccgtcgagttcttctcgaccagattgtcccagcgcatggacgcctcctcggtagcactcaccgcagaatagaacacttgttcccttgatcgtgctgggcgggcccgtggcgctccccgactagcgtgtggccctgttggacccgctgcatccgaccgggaggtcccgaccatggccgccaagttcaccgagctcgcgatcgactgcgcggatcccgccgccctcgcccggttctggtgctcggtcctcgactacgaggtacgggacgaggacgcggaggaaggtgtcgtcaccatcggcccgcccgcggcgcccgaagcggagggccgccccggccccgtaccgccggtgctgaccttcgcgcgggtgcccgagggcaagagcgtcaagaaccggctccacatcgacgtcagtcccagcgaccgggaacagggcgacgaggtccgccggctgctcggcctcggcgcccgccgcgccgacgtcggccagggcgacgcgacctggatcgtgctcaccgacccggagggcaacgagttctgcgtactcggggaccgccgaccctgaacccggacggccccgattttgagcggctgtgcccgagatggttggctcagctcacccaccggacaaccgactgctggaggaacagccatggcgcaggtcgaggccacgacggagcggatcatcgcggcggaagcggaggcggtgttcgacgcgctggccgactacaaggacgtccgcggcaaggtgctgaccgggcacttcagcgagtacgaggtcagggagggcggcgacggcgagggcagcctcgtgcactggaagctccaggcgaccagcaagcgcgtccgcgactgcctgctggaggtcagcgagccgaccgacgggcagctcgtcgagaaggaccgcaactcctccatggtcaccacctggaccgtcaccccggccggtgaggggaagtccaaggccgtcgtgaccacggtctgggacggcgccggcggcatcggcgggttcttcgagcggaccttcgcacccaagggcctcggccggatctacgacgagctgctccagaacctcgccaccgaggtcgagaagtaggaccccacgggggcattccggctgcctctccccgcaccggaggcccggacgcgtccgggcctcnncaccggaacgggtggttttccggggtggccggttgtgcgccgtagtgcctcccaccggcgcataagccctttgtgcgcgccgcgtacgcccctcgtcacgtttgccccgccttgccgcgcgatgcgagaaatgggcggcgcaggtgcgacgaggggagcgttacgtggtgggtggtatcacgctggtgaaggacgagccggacggcccgggaccggacggcccgactccggacggcacggcggcgacggtcgaactccccgccgcac

SEQ ID NO: 4090 - DNA, 2806 bp, Unknown
  Kingdom: Bacteria, Phylum: Actinobacteria, Class: Actinobacteria, Order: Streptomycetales, Family: Streptomycetaceae, Genus: Streptomyces
acggcgggggcgggcgacgcctgagcggtgcccgggaggaggagtgctcccaggacgagggctgcgaccgtgctggggacaagtctcgcgcgcatgagggctcctgtgggggacggggccgtacgggaacatcggcgcagggacggcgtgggggccgtccggccgggtgcggtgcggtggcaggagccagagtggagtcccggccgagccgggcacaagcggtgtaagtccaggcttacgggtgcggttcaccgtccggcccgagcccggcacggcggtcctccgcggccagcagcgcacgaccctcggcggtcgcgacgtgaaaggcgcggccggccgtgcggacggtggtggtcaggcccgccgcgcgcaggacgttcatgtgctggctgacggccgggtgggtcacctggagcatccgggccgcctccacggtggagcagccggcgcgggtggcccgcagcaggtccgcacgggtctgcccgagaaggcggccgagggggtcccggcccttcgccggtcccgccgccccggggggcccggcccagtcggccgtgtggtggatgggatggaccaggacgggcggcagagcgccgtccgccagggtggtcggggtgggccagcagaagaacgacggctggagcaccagcccccgcccgtccagccgcaggtgctggtggaccggataggtgacctccagtacgggcggccgccaacgtacgtcgggcccgagcccggccagcagcgcctcggtgccgccgtccatcaggtgccgtgtccgcagcgcccggtccgcctccaggtccgcgcggacgtgccgccagtgcggtacgagcgcttccgcctggtaggcgtggagcgcctcgcccagccgcgcgagcgcgtccgtgtcgccctcggccagggaggcggcccagccgggcagccgcgtcgacccggccagccgggtcagctccgcacgcagccgcggccgcggtgttccgagcagggtgtcgacggcggcccggagcgtggtgcggtcaccatcggtgggggtgaggaagtcgggggagtagccgtgcggcggcagcagcggggagagcaggcgacggctctccgggagccggggccgcacccagcggcgccaggccccgaaaacccgttgtccgtcggtccgttgaagagtctgcacgctgttggtgatctcccacaggaagtccggccccggggccaccctgacccgcgtcaggtcctcggacgtgaagtggatccgcagcatggacgctccatcggaaggcggggccggccaccgcacccgcgggccgccgtgcgaacaccggcggggaacaggccactacccgccaccgcgacgggatatgccgcgccgacggttcggccgcggccgccgcgcgcgacgcggttcggcgacgccggggccgggaccgacccggtccgtggacccgcatgatcacccgcgtcgcgatgggagcggttcctccggagcgaggaccggtacgtcgaggatggcgatgctccggccgggcagatcggtgccgtcggtactgcgcacgtccgccggtgcgtccgggccggtgacccaggggaagacgccgtcccggcgtactagcgacggcacaacacaacctggtcaggccatgcgccgtgcagctcacccaaccggtgggaaggtcgaagcggccccggtaatcccgggaccgaagcgtagtgcggccctgtcgagagccgtctcaaggcggcggagattctgatcctggtcgtcaaaggtgagctggtggactgagtcctcggcgggccgcagacgttctgctcgtagggcgagtgtgcggacgcgggcgcgttggaggccgaggctggtgaggagttcgcgggcggtggtggccagggcgggggtgtgggcggtcgcctcggtgagggtgcggctgcgggtggtctgggtgcggtcggcgtaggtgacggtgagcgtgagcgcctgggtgatctcgccgctggtgcgcagccgggcgccgagctcctggacgaggcggaggacggttcggcggtgctggtcggggtcgagtgcgtcgcggtcgaagcggtggccggcgctcatggtcttcggggcggcgcccgggacgacggggcgctcgtcgatgccgtgcgcgaggtcgtgggcctggcgtgcgaccccggcgccgaggatgcgctggagggtggggagctgggtgtcggcgatgtcgccgacggtggtgatgccgtagcgagtgagggtcccggcggtcttggggccgatgcccggcagggcggcggtcggcttggtgcggaggaacgcggcgatctcgtacggatcgtcgcggaccaccgtggccgcgccgggcggggtgacgtccgcggccatggccgcgacggaacgggtggggcccgctccggccgaactggggacgccgtggagcgcgagcaggcggaggcggagcacggcgacgaggccctcgacgtcgcggccccagtatgtgagggcgccggtgaggtcgacgtaggcggaccagtcggcgggcaggggttcgacgcgggagctgatgccgtcgaggacggtgaggagctgtccgtacagttcctcgctccgctcggcgggatggaagtggatccgcaggatcgcgcgggtccgtcgcggggaggcggggttcgcggtcatccggcgctcccttggctcttgtgcccgaagcgggtgaggtcggccgagcgggtcccggcgggctggaggtcgctccaggggtgcaggcgggcgcccgcggtgccgtcggggatcgtccgccgggggccgggctgggcg

SEQ ID NO: 4091 - DNA, 587 bp, Unknown
  Kingdom: Bacteria, Phylum: Actinobacteria, Class: Actinobacteria, Order: Streptomycetales, Family: Streptomycetaceae, Genus: Streptomyces
  misc_feature (376)..(377): n is a, c, g, or t
gggcctcacggtccaggaggacggcgcgcggtccgtcgctcggactgccgaagcggatctcgctgcccgcgccgacgtccgtggcacggatgcgccggccgccggtgtacgtgccgttggtgctgtcctcgtcctcgatcgtccagtgaccggcctcggggtgcaggatcgcgtggtgccaggagacccggatgtcgtcgatgaccacatcgctctcggggtcgcgcccgacatggtagtcccggctcggactcatcaccgtggagcccagatcggtctccagaacgagttcgggcgcagtcggcgtcgcaggccgctctcccatggcctgaattctaccgatacgtcacgatcggcgcccactgttcaggtctgnnccgcccgccgcctcgcggacccgtacctcctgggccagccgctggaccatcggccagccgaatccgccggtccggccggtcagatcgggcgtccggtcctgcgggtgcgccgggctcgggtcggtgacccggacatggacgcccctgtggtccgcggtcagccacagcgcggtgacggcccccgcgtgcaggacggcgttggtgaccagc

SEQ ID NO: 4092 - DNA, 906 bp, Unknown
  Kingdom: Bacteria, Phylum: Actinobacteria, Class: Actinobacteria, Order: Streptomycetales, Family: Streptomycetaceae, Genus: Streptomyces
ccccgagcagctggaacgcctccgagaggccgtgcgcggcgatgaactcggccacccaggaagcgcgttcggcttggtccaggatcgcgaggagcttcgagcgctcggcgatcgaggccgtcccggggccgctcgccgggggtgccgaagggcgcccgagcagggcccgggcccactgcggattccgctgccgcacggcggcccggcaccaggcggcgtgcagctcgcccgcccagtcgtcggcgacgggcagggtcacgacctcctcggcggtgcgaccgccgaaccgctcctcccagacgccgagcggggtggcctccaccaactgccccagccaccaggaccgttcgccccggccggtcggcgggaccgcggcgacgccgtcgcgctgcattcccgcgtcgcactcgtgcggcgcctccacggcgatggaggtgctgtcccccgtacggtccggattcacgcaggacatcgcgcgggccgccatccgtccggcgagcgccgactcgggcagggccgacagcagttcggcggcggtggcgcggacgttgcggctgcggtcggacagggcctgttccaggaacggctcgtcgtcgcctccgagtccggaccgcagggagtccaggaacatcagccggtcctcggcccgttcggccgaccaggtggtggcgagcagggcgatcgcggcggccggatcctgcgcccgtacggcgtcgagcagtgcgacccgctccgcgaacagtccctcctcccacagtcggcgcaccgtcgccgggtccgtgatgtcggggtggagcgcgccgctcgccgcaccccgcagggcgaacttccagtcggggttcagcccggccagccacagaccgcgcggcccggcgaacgcgagcgcctgcgggcgcaggtccgtac

SEQ ID NO: 4093 - DNA, 1025 bp, Unknown
  Kingdom: Bacteria, Phylum: Actinobacteria, Class: Actinobacteria, Order: Streptomycetales, Family: Streptomycetaceae, Genus: Streptomyces
gagctttgatgagcccggttccgaccgaggacgtctacgaccggatacggatgcggcagtgggccggcggccgggcacgctccgccgggatcgaccgccgcgatctgctgaagctggtcgcggcggcctcggccgccgtgccgctcgcctcggtcgccgcacccgcgcgggcggccgacgggctgcccggggtggtcaagccgctgcctccggagctgttcacgctgcgcggcaccaacgcggagacgaacttcgccgccctgcgggacaccgggctgctcacacccgccgaccggttcttcgtccgcaatcacaccgccaccccgcgcatcgaccggaccgactggaagctgacggtccggggcgacggactgacgggcggcccggtggacttcaccttcgcggacctgctgaccctcccctcggtgacgcgcaccgcgttcgtggagtgcgcgggcaacggccgcagcttcttcacctcgcagcagggtcaggcggtcagcggcaccgcgtggacgctcggggcgatcgggacggcacgctggcgcggggtgcggctggcggacgtcctgcgccgggcgggaatcgggcggcacgcggtggacgtcctgccgcgcggcctggacgcggaggtcgtcaccgacggagtgaacctggggcgggtgcgccgtccgctgccggtggagaaggccctggacgacgtcgtcctcgcctacgagatgaacggcgggccgctgccgcccgaccacggctacccggtccggctgatcgtgccgtcctgggtgggcatcgccaacatcaagtgggtcggcgacatcgaggtgagcgccgagccgctgctcaccccgtggaacagcggcctctaccggctgttcggtcccgggcatccgcccgagggaagcgcgccgctgacccggcagacgctgaagagcgccttcgagctggcgccgggtgcgtcgttccgcgcccatcggcgcacgctgctgaccgggcgttcctggtcgggcggggcgcccgtgcgggcc

SEQ ID NO: 4094 - DNA, 1182 bp, Unknown
  Kingdom: Bacteria, Phylum: Actinobacteria, Class: Actinobacteria, Order: Streptomycetales, Family: Streptomycetaceae, Genus: Streptomyces
gcacggtgccgcacgcggcgggccgggtgctgcgggacggggcgccggcgccgggcgagtacgtggcggggtggatcaagcgggggccgaccggggtgatcggttcgaaccgctcctgcgccaaggagacggtcacctcgctcctggaggacgccgccgcactgaggcgccgcccggcggcggacgacccgctggccgtgctgcgggagtgcgggctgcggccggtggagtggtccggctggctgtcgatcgagcgcgcggaggcggagctgggccggtcgctggggcgcggaccggtgaagatccccgactggccgggtctgctggcggcggcccgggagagggaccgctgaccagcaccgcgagcagggcctcggcgcacacgacaggccctactcccgggtcgccaccaccagccgggcgcggggactgccgtcggggcgcaggcccatctcggtcagcggcagcagccgcacgacgaatccggcctgcgtcaggtcctccagcacatcgccgagccggaacgtgcggtagtacatgacgaaccgcgggcgccacagggcgttgcgcacccgcatcgccgcgtcgaagccgaacagggaccagtaggcgcgcgatcccaccggcggcggtgcgccgagcgggaagacgaactgcccgcccggccgcagcgatccgtacacctcggcgaagaggccgaagcgctcggcgggcaggaagtggccgaaagcgccgaagctcagggcgagatcgaaggcgggcgcgaagggcagggaacgggcgtcggcccgcacccagtgcaccgccggtccctcgctcccgggcgggaaggcggcacgggcctcggccagcatgcccgcgctgaagtcgacgccgaccgcacgctcccggcacagctgccggagcacgccgacccccgcgccggtaccgcagcagacgtcgagtccggcgtcgaagggtccgagctcgcgcaccgcccgggtgacggcgtcgagcacacggtcaggggtgcggtagggcgtctcgtcgaacttcggggcgaggaggtcgtatccgcgctccgtcgaggaaagcgcctggacggccagttcgcgcacggtggggccctgtttggtgaacatcacgggtcaccctaccgacgcggcgcacccgctgcggccggccagggcggccctgcgggag

SEQ ID NO: 4095 - DNA, 574 bp, Unknown
  Kingdom: Bacteria, Phylum: Actinobacteria, Class: Actinobacteria, Order: Streptomycetales, Family: Streptomycetaceae, Genus: Streptomyces
cgcggtgacgaccagaccggccgtggtcaggtgcaccagctggcgcacggtcctggccccgccgaccaggaagacggcggcccggccggccagaccggtccgggtcacggctgccgccaggacgaaggcgcagatcagcagccacaccgtttcgtcacccagggtggcgaagagggtctcactgctgatcacccccgtgacggtcagcgccagacccgcgccgagggcgatgtaggcgtcgtccaccggagtggcgatccaggcggcggtggccagggcgaagacggcgagggagagccgcccgtcgacgctgaggccgggggcggcgccggggacggcgaggagagcgcagagtccgaggacggcgcagaggcagacggtctgccggagtggtagaggcacgctgtacagcctccgaaggcggggtgagtgcctgatgagcgtccggtgaaggccttttcatcaagttcggcgcgcggctcacccccccccacggcccgggggtcagggcaggcggtagcccatgccccggatcgtctccagccgctccgcgcccagcttccggcgcagcgcg

SEQ ID NO: 4096 - DNA, 6216 bp, Unknown
  Kingdom: Bacteria, Phylum: Actinobacteria, Class: Actinobacteria, Order: Streptomycetales, Family: Streptomycetaceae, Genus: Streptomyces
tccgccgtacggcggagcaccgtgcggcgcggggcgatgcgcacgatccgggccagggtgtccttctcgccggagagatcgccgacgatggagacggtgtcgcccaccacggcggccttgcggcccagctcgcgggccttcatcgccaccacggtccggccctcgacgaggcaggtgagccggccccggtcgacggtgaggaccatgccgtcctcggcgtcctcgtgcttgggccggatgtgcgtacgcggccggttgcccttgcggttggggcggacgcggatgtcgtcctcgtcggggttctttccgtaacggcgcatcttctaggccccgagcattccggtccacatgtccgggaagtccggcagggtcttggcggtcgtgctcacgttctcgatctccacgcccttcaccgccaggccgatgatcgccccggcggtggccatgcggtggtcgtcgtacgtgtggaagacgccgccgtgcagcgggcgaggtcggatgtgcagtccgtcggccgcctcggtgacgtcgccgcccagttcgttgatctccttggtcagcgcggccagccggtccgtctcgtgcagccgcagatgggctacgccgctcagcgtggagggggagtcggccagcgccgcgaccgccgcgatgcccggggtcagctcgccgacctcgccgaggtccacgtcgatgccgtggatacgtcccgtgccggtgaaggtcagcccgcgctcggtcagctcgcagctgccgcccatcgcggtgaagatctcgcgcagcgcgtcgcccggctgggtggtgcgctcgggccagtcggggatcgtgacccggccgccggtcaccagggcggcggccaggaacggctgggcgttggacaggtccggctcgatcgtcaggtcccggccgagcagagcggagggggagacccgccacacgtctcgctcgccgcccgtctccggctcgtccacctgggcgccgacggcccgcagcatgtcgacggtcatccggatgtgcggcatcgaggggagcgtggacccggtgtgccggacctccacgccctggttgaagcgcggtcccgacagcagcagcgccgagacgaactgcgaggaggacgaggcgtcgatcgccaccgggccgccctccagggccccgacgccgtgcacggtcagcggcagcgccccgcgtccgtcgtcgtcgatccgtgcgccgagcgcccgcagtccctcgatcacaccggtcagcgggcgctcgtaggagcgggggtcgccgtcgaagcggaccgggccgtcggcgagcgtggcgacgggcggcaggaagcgcatgaccgtgccggcgttgccgacgtcgaccgcggccgggcagtggagccctgccgggatgactcgccaggcctcgcccgagctgtccggggaggccgcggcggacgggctggtggcggacgaggaggagacggtctcctcgatcccgacgcccatggcgcgcagcgcgtcggccatgagcagggtgtcgcgggagcgcagcgggcggcgcagccagcccggctcggaggccagcgaggccagcacgagcgcgcggttggtgaccgatttggatccgggcacggtgacggtcgcgtcgacggcgccgctcgcgtggggggcgggccagagggcggggtgcacggaactctcggtcatggccatcactttagtggctccgcgccgacccggatcctgatcaaaagggcggaaaccggcccgtaacgaaggagtggtacggaccgcggcggtccaacccgccctcaccaccccagcagccaccgaccgccgccgatcagcgagcacagcgacaccgcgtggaagaggaacagccacagcaccgccggggcgtgggtcagccgggccagctggtccgcgtcggagtccggggcgcctccgtagcgccgcttggactggagctcgaacggcggccgtaccccgcccagcagcaggaaccacaccaccgcgtacgcgaacgccgactggacgtccgaggaggccagccaggacaccagcaggaaggcggtgccggtcaggatgacggtgagggccccgtacacattgcggatcatcaccagcatcaccgcgagcagtgccgtcgccacccacagcagcagggtgatcctgccgttggtcagcagccaggcgccgcccaggcccagcagcgagggggccgtgtagcccgccgccgccgtgaggatcatgccgatccccgtcggcttgccgcggctcaccgtcaggccgctggtgtccgagtgcagccggatgccggagagccggcgcccggtgagcagggccaccaggccgtggccgccctcgtgcgcgatggtgatggtgttgcgcgcgagccgccatatcggattgggcacgacggcgacgagcgccagggtggccgtcaccaccaccagccactgctcgggagcggactgggttccggtgacgcgatcccacagatcgccccattcggtgctgttcatcggccgggcgactccttgcggtcggggcgggcggtcgtggcagtctggcacttatgtgcggacggtttgcagcgagtcggaatcccgaggacctgaccgggctcttcggcgtcgagaagtgggaacccaccgagaccctggagccggactggaacgtggcgccgaccaaagaggtctacgcgattctggagcgtcctgttaaggacgccgacgaccagcgtccggttcgccagctgcgcgccctgaaatggggactcgtgccgtcctggtcgaagtcccccgagggcgccgcgcggatgatcaacgcccgcgcggagacggtgcacgagaagccctccttccgccgtgccttcgcgcagcgccgttgcatcctgcccgcggacggctactacgagtgggtcaccggctcggaggaacggcagctggaggagaagaagggcaagaagcgggcccgtaagcagccgtacttcgtgacccccgccgacgggtcggtcttcgcgatggccggactgtacgagttctggcgcgacgcgaccctgcccggcgaccacgagaacgcctggtgggtgacgtgctcggtgatcaccaccgaggcggagaccaccccgctggccgtcgcccccgccgaggggcccggcgcgctcgccgacatccacccccggatgccgttgatgctcacccccgaccgctgggacacctggctggaccccacgcacacgggtgtcgaggagctgcgcgcgctgctggagccgccgccgggcgggctgatgcgtgcctacccggtcgccaccgccgtcagcaacgtccgcaacaacgggcccgaactgctggaggagctggccgcgccggaggagtccaccctgttctgagcggcgcgcgggatccgggcggcgcgcgggagaggatggcgcggtgagccgtcaaccacgtacgcagaacgtcaccaccgacgccggtgaggccaggatcacctgggtcacctcgcccgcgccccgcctcgtgctggccgtcggccacggggcgggcggcggcatcgaggcccgcgatctgaaggccctggccgcgaccctgcccggactcggcgtcaccgtcgccctggtggagcagccctggcgggtggccggcaagaaggtcgcccccgccccgaagaccctggacaccggctggcgcgggctgtggcccgccctggccgctcccgggcttcccgtcgtctccgggggccgcagcgccggggcccgggtcgcctgccgtacggcgacggagctgggcgcggccgccgtcctcgcgctcagcttcccgctgcacccgccgggcaagcccgagaagtcccgcgccgacgaactgctcggcgccggagtgcccaccctggtggtgcagggcggcaacgaccccttcggccggcccgacgagtttccgcccggtccgtacgcgctggccgaagtgccccacggcgaccacgggttcgcggtgccgaagaggtccggggcgaccgaggagcagacgatgcgcttcctcaccgacgcggtggccgagtggatcgcgtcactcggatgaccggatccgcctcgcggtgacccgggcctcacgcccgtggcacaggccccgggaatgctccgcccgggggcgctgttgttcgggacgtcggtacagacacgtggtacccggaacatcgtggagagggagtccgtcgcatgggttcgaccatctgccccagccgctcgaacgccgctgacctggagtggaccgtgctgcctgcggcgaggaccagccacgagcggccgaagggcgatcgacagcccgtctcgaagcaaggtcgactattctccgatgcgagcgggtccggtttcggctccgccacatcgttggaggaggtgggtccggtcactgggaccgacacagggaccgacgacggccgtgcaccggagacgtccgccgagcgtaacgcgcgcttcgagcgggacgccctcggctttctcgaccagatgtactcggccgcgctgcgcatgacgcgtaacccggccgatgccgaggacctggtccaggagacctacgccaaggcgtacggctccttccaccagttccgtgagggcaccaacctcaaggcgtggatgtaccgcattctcaccaacaccttcatcaactcgtaccgcaagaagcagcgggagccccagcgcagcgccgccgaggagatcgaggactggcagctggcacgggccgagtcgcacatgtcgaccggtctgcgctcggccgagtcccaggcgctcgaccatctcccggactccgacgtgaagtcggcgctccaggcgattcccgaggagttccgcatcgccgtgtatctcgccgatgtcgagggctttgcctacaaggagatcgcggacatcatggggactcccatcggtacggtgatgtcccggctgcaccgcggccgccgccagctgcgcggcatgctggaggactacgcccgtgagcgcgggctcgtcgcggccggtgccggtgactcggacgatcggaagggctcggcctcatgagctgcggagagccgcacgagacggattgctcggaggtcctcgaccatctctacgagtttctcgaccgggagatgcccgagggcgactgcaccaagttcgaggtgcacttcgaggagtgctccccgtgcctggagaagtacggcctcgaacaggccgtgaagaaactggtcaagcgctgctgcggtcaggacgacgtcccgaccgacctgcgctccaaggtgatgggccggatcgacctgatccgggccggcgaggccgtgcccggccgggaaaggcgcaccgcatgagcagcggcatccagcagatccacgacgtgggggcgaaggccctcggctggctgtacgaacaccgggagggattccggctggaggccgacccgtccccggaggcggggatgctggaccgcttcaagccgctgggcgagctggcgctgatcggcaaggtcatcttccgcgaaggcgtggccggctcgcagcagtcctccctggcccgcaagctcctggaccacgcctggcacgagctgctggactccggggcccggctgctggagggccagcggcgcgagccgctctcgccagtgccgctggaggtctacgtaccgttccgggagctgggataccggcagccggacctggagaccgcgatccgcctcaaccaccggctggccagctgggcggcactggaggtgctgccggtgcggcggctcggcctgagcgcgatcgagcggcgcttcggggaggagccgagcgtcccggagacggcggcgctggcgcacacctggctggcgcggcggccggagccgtggacggtcgagggccatatcggctacgacatcacgcacacggtcttccacctcaccgactggggcgagaagcccgccggcctcccggccgacatcgcggagtatctggccctctggctgccggtgtggctggacgactggctggacctgaagcgctgggacctgctgggcgagctgctggtcgtcgacgcgtgcctccccggaccgacgctggacccggcggcctggcaggggttcgcgcaggcccagcagccggacggggcgatgccggtggtcggcgggatgccggaaggggacgaggagtcggtgttcgacctcgtctaccacccgacgctggtcgccgcgttcgcctcggcgctcgcgatgtcccgcgccctgtccgacctcagcgc

SEQ ID NO: 4097 - DNA, 1455 bp, Unknown
  Kingdom: Bacteria, Phylum: Actinobacteria, Class: Actinobacteria, Order: Streptomycetales, Family: Streptomycetaceae, Genus: Streptomyces
cctctccgacgcggagtacaccttcgtcggcgagctgacgcggatcgcccaggtcccgctccccgtcacggacaacctggtcgtgggctggacggagctggtcggcgcggctcgctggcgcggccggaccaggcgtccgctgaccgacatcctgcgggaggacccgcacgcgcccgagctggcggcccggctgttcgagatgccggagctgccgccgcaggtcgacttctacgacgcgccggactcgcgggaccactggcccggggcgctgtgcgcactggtcgaggacgggttgctggaccgggcacacctggtggagcggtgcgtgatccgcctgatgcgcggtggcaggtccgtcgatcagcggttcttcctggccgttctcctgcggttggggacgacggaggaagaggaggaccggcatctgcgggactggacggcgatggcgacggacgggatcacgccggtcgcctcgtacgcccagcaggtgctcgtgcggctcgacgcgcggggcgggttgtccacccgggagctggcggacgtgtcgggcgccgtgctcttccgtcaggagaagaagctggtgcgcgcccagctgaccctgctgagcaaggtgttgcgccgggacgcctcgacggcggacgagcttcttccggcggtcgccgaggcgttcggccacgagggcatcgacgtccaggagcgggccctgaagctggtcgcgcggtacctccccgcggtcgccggcccgcaggtgcgggaggagctggcctccgccgccgcgcggctgggtcccctgcaccgggagacggtcaccgccctgttcggcgatctcgtggaggaggaagcggccgaggcgtacgaggagttcctgccgcccgcgccggtgctgcggcgtcacgatcccgcaccggagaccgtggcggagctcgtcgaggaggtggccgcccgggtgaagtcgcatgcgtcggaacgctggatcccctcctcgggcgtcgcggccccctcggccggggacacccacttcgagcgcacactcgacgggctcgtccggctggcccggacccaccgggaggagctgacggaggccctgcgggaggcgctggccggtgtgcacttcgtcgagcacggcctgggcccgtacatggtcgacccgcgctccatctcgacctcgcacgggacttcggtggtggtcgcctcgctgctgggcctggtgtccgaccgggacagggtcgcgtggcgggcgaagaccactgtctcggcgccggacgcctgtgcccacaccgcgctgaacggggtgctgctggaccgggcgtgggaggccgcggaggcgatagccgccggggaggcgccgttcctgctggccacgccgacctggcacaccggggcgatcgaggcggccgagctcgtcgaacggctgcggatctaccgggagtcgggcgcccgccccggtgtgccagg

SEQ ID NO: 4098 - DNA, 708 bp, Unknown
  Kingdom: Bacteria, Phylum: Actinobacteria, Class: Actinobacteria, Order: Streptomycetales, Family: Streptomycetaceae, Genus: Streptomyces
  misc_feature (495)..(578): n is a, c, g, or t
ggatccggccggtgtgtccacccgggtcggcgcgtgctcgccgggccggaggcccgccgccgcggcccgcagcgcggcgacgaaccgcaggcaggtctcgtaacggtcctccggggacttggcgagcgccttcgccagtacgccgtcgacggcgccgggaagaccgggtcgcagcgcgctgggcggggcgggcgggtcgtactggtgggcccacagcagcgccatgtcgtcgtcccgttggaagggcggcgcaccggtcagggtctcctggacgacgcaggcgaggctgtacacgtcgcaccgcccgtccacgggtcgcccggagatctgttccggcgccacgtagtccagggtgccgacgaactggccgaccgtggtgaacccggtcagcgacagcgacttcttcgtcagcccgaagtccgtgaggtacacgtgctccggatggtcgctgtcggtgcccgccgcaaccaggatgttgccgggcttcacgtcccnnnnnnnnnnnnnnnnnnnnnnnnnnnnnnnnnnnnnnnnnnnnnnnnnnnnnnnnnnnnnnnnnnnnnnnnnnnnnnnnnnnngcggtccgcgccggtcgatcaggacgcgcagatcggcgcccgcgacgaaacgcatggcgatgtagagcagcccctccgtctcgcccgcctcgaacaccggcacgatgtgggggtggtcgatcgcggccgc

SEQ ID NO: 4099 - DNA, 2511 bp, Unknown
  Kingdom: Bacteria, Phylum: Actinobacteria, Class: Actinobacteria, Order: Streptomycetales, Family: Streptomycetaceae, Genus: Streptomyces
ctcgacgtggacgcggtggatgatctcctccaccgcgtccacgtcgagcggcggcagtccggggatgccggggatccgggcgatctcccgcagccccttcaccgagtcgtcgaccgtcgtgaacgggtagtcgctgccgaacatcaccttgtggaagaccccgtagtcctggaccagccggaggctgtgccagagctggaagggccggtagtgcagggcgctgatgtccgcgtacacatgcgggtgcttgcggatgaccgcgatgcactcgccctcgaagggatggccgaggtgcgcgaggaccatccgcagttccgggtggcggatggcgaccgcgtccaggtggcggggcatcgcccactccagcggcgcgctcgacacgaacgtggtgccggtgtgcaccaggagcgggaggccgtgccgttcggcgtaggtgtacagctcgtcgtactcctcggcggccgggtcgaagcccgcgtacatcggcatcagcttgatgccgcgcaggcccagttcctggtggccgtagcggagttcgtcctgccagccgggctgggtggggtccagggacaggtagccgatcagccggtccgggtgctgtccggcgtacgaggccacggccgtgtcgtcgacccagaggccgctgcgccgcgccttgcctccgacgacgatcgtgcgggtgccctcgggggctgtggcggcgtaatcctcccacttcaccgtgaggtcgacctcgcccgcgtgggcgcgggcggagtcggacttgaacgggtcggtgaagtcgtggctgtgccggaagagatgcgagtgaacgtcgacgatcatgtgcggttccgcttctcccagccgtccgcgaacatgttccagaagcggtggctgggcgggtgctcctcgaagacctcgtcgacgagctcgacgccgaggcccggtgcggtcggcaggccgatgcggccgtcgacgatcgggagggtgcccttgagggcgtcgaagacgtagctctccaggagtccgtcgaaggtttcgaggatcttgaagttggggattccgagcgtcgcgtgcaccgagacggtggtgcagagcggcgagttcgagttgtgcggggcgacgagcatgccatgggtatcggcgatcgcggcgagtttcctgacctcggtgaagccgccggccatggacaggtcgggctggatgatgtcgaccgcgtgggtggcgaagagctgcttgtactcgtagcggttgtggaagtgctcaccgccggagatcgggaacgcggcgcgctgacgcagttccgcgtaccgctcgatgtgggtccagggcatcggttcctcgaaccagccgatgtcgaagggttccagctcccgcaccagccgggccgcggtcggcatggcgaacctggcgtggccctcgatgaacaggtcgacgtccggtccgacggcctcgcggacggcggccacgaggtcgatcgagcggcgcagttcgacacgctccagctcgtgcaggccggggccgaagggatcgaacttgagggcggtgaagcccttcgccacggtctcctcggccttggccgcgaaggtctgtggctcgcgctcgccggtgtaccagccgttggcgtacacgcgtacgtcgtcgcggcaggcaccgccggtcagccggtaggcggggacgccgagcgccttgcccatcaggtcgtacatggcctggtcgaggccggacagggcgacgccgcccatgtcgccgccgcgcaggaagtcgccctggtagacgcggagccagagctcctcgatgtcgaaggggtcggcgccgatgaggtggcgctgggccagtgcctcggtgagggcgcagacctcgcggacccggtaggggtgggtgatctcgccgatgccggacaggccctcgtcggtgtggacccggacgtagccgaagtcgcgccaggaggtgccgagcatcagggtctcgacgcgggtgatccggccggcggggcccgccgggcgggtgcggttgacggtgagcatcagcgggtcgccccgcccatggtggaggtgttctccaggtcgcgggcgccgccgtcggcgaggacggccttgaccgcggcctcggtgccctcgatgaggcggtccacgtcggcgtcggtgtgggcgtagctgatgtggctgcgcttgaggttgagcggcagctcgaacagaccgtggtcgaggagctttcgacggtagccgacgaagagcgaggcgtcgttgttcagcaggtccgcgtaggtgcggggggcctcgcccggcatgaagtagctgacgaagacggagccgtagccggtgacgacggcggggacgccgaggcgctcgtacagtccggtcagtccggtgcggacgcgctcgccgagccggaagacgtgctcgtggaccggctcctcgcgcagcttgcggagcgtggcgagggcggcggccacgacggacgggtggccgttgtacgtgccggcgaagaaggcgggggcaccggggcgggtggagaagaggtccatca

SEQ ID NO: 4100 - DNA, 1876 bp, Unknown
  Kingdom: Bacteria, Phylum: Actinobacteria, Class: Actinobacteria, Order: Streptomycetales, Family: Streptomycetaceae, Genus: Streptomyces
gtgtaggaacaggtagtcaggcaaccgtcgaaaggatcggttccgtgcgtggtgctctgttcggacctgtgcagtccccggcgatgcgcaggggggtggtggccgtgctggcgtcggccgccctgctgctgtccgccgcgtgttccggcgacggggacgggggttcgtccgggcagcccgccggttcgccgagcgcctcggggggcaccgctcccccggcctccccgagccggtccgccgatctgccgcccgcgaagggctcggcgaaggtggtctcgacgctgaccgaggacctgaagtcgccctggggtctggccgcgctgcctggcggtgacctgctggtgtcctcgcgcgacgagggtacggtccaccggatcgacggcgagagcgggaagcagacgctgctgggctcggtgcccggggtgtccccggccggcgagggcgggctgctcggactcgccgtctcctccacgttcggcgcggaccagctggtgtacgcctacttcaccaccacgtccgacaaccggatcgtccgcatgagttacgacgagaagcgcccggcgggacagcagttgggggcgccggacaccatcctgcgcggcatccccaagggcagcatccacaacggcggccggatcgccttcggcccggacaagatgctgtacgcgggcacgggtgagaccggggacaccgggctggcccaggacaaggagtcgctggccggcaagatcctgcggatgacccccgacggcgagccggtgcacggcaatccggaggcggactcggtggtgtattcgtacgggcaccgcaatgtgcaggggctcgcctgggacgcgcagaagcggctgtgggccgccgagttcggccagaacacctgggacgagctgaatctgatcgagcccggcgggaactacggctggcccgaggtcgagggccgggagggcgaggacgggttcatcgacccggtggcccagtggaagacctccgaggcctcccccagcgggatcgcgtacgcggagggctcgatctggatggccgggctgcgcggcgagcggctctggcgcattccgctgtccggcgagaaggcggaggaaccttctgccgacccccagtcgttcctggacgggaagcacggccgcctgcgcactgtggtgagtgcggggagcgaccgcctgtggctggtcaccagcaacacggacggacggggtacgcggaagcccggggacgacaggatcctccaggtggaagtgggctagccgcccgcccgcgcggcatgtcggagggagcacggccggtgttcaatttcttcgaggagctcttcgccccggggcgcaagcacgcctccgacgagcagaagcggctggagctgagccgggtggatctcggcatcggcgatccgaaccggggaccgatagacctgacctccggcaaggtgaccgtccgtgccccggccccggagaccgctcccgccgtggccccggacgccgcccccgagcaggacgccgtcctggaccggccgggacccggtaggccggtgagcgggcccgagcggcgcgcggacgaggagcccgggacttgaggccttacgcggccgggtagagccggaggcggtgggcgagggcggccgcctcaccccggctggagacgccgagcttggccaggatgttggagacgtgcacactcgcggtcttcggcgagatgaacagctcctcggcgatcctgcggttggtgtgcccggccgcgaccagccggtgcacgtcctgctcgcgcggggtcagtccgaaggacgccacggcggcgatggcggggtcctgttcgtcggccgacggccgctcggggctccctgcggcgggtacggcggccaggacggccgggt

SEQ ID NO: 4101 - DNA, 1179 bp, Unknown
  Kingdom: Bacteria, Phylum: Actinobacteria, Class: Actinobacteria, Order: Streptomycetales, Family: Streptomycetaceae, Genus: Streptomyces
ttggtgccgccgatgtcgagcgcggcgacgaggtcggtatgcatcggtgtgggctctccggatcggtgaaggggcgggacctgcgggttccgtccacagtctgcacagtctccattctgttgacaacgttgtccagggcctatgctcgacgccacagcctccgatcacccccgcggcgcccgctccggccccgctcggcagcaccgcagcaccgcagcccgcccgtaatccgacgacaggacagcgcacgtggaccggaccgcccgtcattccgagacccgctacggcaaccggccgaccatgaaggacgtggcggcccgcgccggagtcggcctgaagacggtctcccgggtggtgaacagcgagcccggagtcacacccgacaccgagcgccgcgtgcaggaggcgatcgacgcgctcggattccgccgcaacgacagcgcccgcgtgctgcgcaaggggcgtacggcatccatcggactggtcctggaggatctggcggacccgttctacggtccgctgagccgcgcggtggaggaggtcgcccgcgcgcacggcgcgctgctgatcaacggttccagcgccgaggatccggagcgggagcaggagttggtgctggcgctgtgcgcccgccgggtggacggtctgatcgtgatcccggccggcgacgaccaccgttatctggagccggagatcaaggcgggcatcgccacggtcttcgtggaccgcccggcgggccacgtggacgtcgacatggtgctctccgacagcttcggcggggccagggagggagtggcacacctcatcgcacacggtcaccgcaggatcgggttcatcggcgaccagccgcggatccacacggccaccgagcgactgcgcggttatcacgtcgccatgcgggacgcgggcatcaccgtcgaggacggctgggtctccctcggctccaccgagccggagcgggtgcgtgccgccgccgaggagatgctctccggacccgagccggtcaccgcgctgttcgcgggcaacaaccgggtgacggtgacggcggtccgggtgatcgcggagcgggagcggccggtggcgctggtcgggttcgacgacatcgagctggccgacctgctcggcatcaccgtgatctcgcaggacgcggcggcggtcggcaggaccgccgccgagcac

SEQ ID NO: 4102 - DNA, 1145 bp, Unknown
  Kingdom: Bacteria, Phylum: Actinobacteria, Class: Actinobacteria, Order: Streptomycetales, Family: Streptomycetaceae, Genus: Streptomyces
tgggagcgggcggtcgacgcgctgctgccgctcctcgccgacgacgtggaaggcgacgaagacgtccgggccggagtggccgccgtactcgcacgtgccacccaccgggcggacgacctcgtcgaccgcttcctggcacggttcgcggacgagcccgacctgtcggcggcggagcaactcgtgctggccgtgggcgagctggcccctcacgcggtggaacggcgcgaggacgccgtcgcatggctgcggcggcggacgaccgaccccgggaagggcgaggagccggacatggacgacgacatcgacgcgtggctcgcctggatggaacagcacgggcacgatgtccggccggccgcgatcgccgcgctgcgccgcgccctcccctcgctgtgacgctgtgacgaccgtcacccgggattcctcatgggtagtgtcgaccggatgacctgcggcgggcgtatacccggtgaagcgaaagatccgggagcaacttttgaccgtcgaggagttcgaagagttctacgcccgggcggtcgcacgtctcacaggccagctgtacgtgatgaccggtgacctccaggaggcgcaggacgtcgtgcaggaagcgttcgtcaaggcgtgggtccggcgcggccggctggagcgcgagggccagcccgaggcatggatccgtacggtcgcctggcggctggcggtgagccgttggcgcttccggcggcgttcggcggacgcctggagccgggggagcggtgcgcccggacacgtggagccgccggacccgggccatgtggtcctggtcgacgcgctcagggaacttcccccgcaacagcggcggacgctgaccctgcactacctgtgcgacctcacggtcgagcagatcgccggggagaccgggctttccaccagcacgatcaagacgcatctggtccgtggccgggcggcgctcgcccaccgtctgcgggacccccgcatcgaggaggctcctgatgtctgacccgcgggatccgttgcggtccctgttccgggaggcgggtgagttcgggcagacccgctccgacgcggacaccgcgtcgagcatcacgcaacgcggaatgcgcgcgcagcgacgccggatggccgtggccgcggtgggcgtgtgcctggtc

SEQ ID NO: 4103 - DNA, 1356 bp, Unknown
  Kingdom: Bacteria, Phylum: Actinobacteria, Class: Actinobacteria, Order: Streptomycetales, Family: Streptomycetaceae, Genus: Streptomyces
accgggcgaccccgggcagtggccggactggtccaacgacgcctggtggcaccacctcgacaccggcgccacgggccggctggagctgggccccggactggtcttccggctcgcggtgaccgcccgccacatcgcgtacacccgcgtccacccggacggcgacgagctcgtcctgctcacggcacccccggtcgccggatcccgcccggaggtcggcgcgcgcctgcccctgcccgccatgtccggtgcgccccggcccggcgggaccccctgggacggcgtgcagcggcgggccgtcgccgcctcccccggcgggggcctggtggcggtcagccggggaggccacggcgaggtccacgtcttcgacgcggaccgggcggacctgctcacgaccctgaccgttccgacacccctggacgacggcggccacctcgccctcctcacccccggggacggggcgcacgccgacccggtcggccgctgagcgacgcgtcgcgggtggcggcgcggcgcgaccgccgccgcaccaccacccgctcttgactcccggccgccttcaccaggaggacttggtcactcccggaaggaatcccgcgtgggcctgctcacgcatccggacccgggagagcccgaacctgcgcagatacccccggggccggccgtcgacgctgtcccggttgcgcacccgcgtggcactggcgtcgcgcggctgacgccgcaactcctcgacggccgcgacacgttcgcgctcaggagtgccgggccggcggatgatctccttgagctcggccctgcgagcggcatagcggtcgacggtcgcccggcgccggtcgttccgcgcgatcttgctcttcttcgccatcagacctttcctccccgcgcccggatgcgcgcgaccgcggcctcgatgccgatgctgtcgacggtcttgatcgcccgagcgctcagcgtgaggcgcacataccgtccctcgccgggcagccagtaccgcttgcgctggacgttcgggtcgaaccggcgggacgtccggcggtgcgagtgggagatgttgttgccgaatcccggcttcgagccggtcagttggcagtgggcggacatgaaaagttacctgcctctccttcgacgcatccattattgaaaatggaaaccattgccatatagtagcgcccatggctcgcaacgaagtacgcccggtcatcaagctccgctccaccgcggggaccggctacacctacgtcacccgcaagaaccggcggaacgatcccgaccggatggtgctgcgcaagtacgacccggtcgcccgccgccatgtcgacttccgcgaggagcgctgaggccggcccgcccgcgcccaat

SEQ ID NO: 4104 - DNA, 3192 bp, Unknown
  Kingdom: Bacteria, Phylum: Actinobacteria, Class: Actinobacteria, Order: Streptomycetales, Family: Streptomycetaceae, Genus: Streptomyces
ctcccgcaccgcctccgccgcctccggcacctccgcgtcgagcagcagcgccgactgctgtgccagccgggccaggagcaccggcggcagccaggcgccgtgcggagcggccgaggacggcgaggacgtcaggccctccaacaaggcgtccacacccgggcgttcagcggcactcttggtcaggcaacgctcgatcagctcccgcaagggggtgtccgtcaccgcttcgaggtccggcggggactggacgatccggaacatcaccgcgtgctggttgctcacaccggccccgaacggcagacgcccggtggccgcgtacatcagcacacagccgagcgagaagacgtccgcccccggcccggtcttctcgccgaggatctgctcgggcgccatgaaaccgggcgagccgatgaccatgccggtgccggtcaggagggactccacggagacctggagcgcgcgggcgataccgaagtcgatgacccgggggccgtcgacggtgagcaggacgttggacggcttcaggtcccggtggacgatcccggcgccatggatggactggagggcctcggcgataccggcggccagccagcgcaccgcctgggtcggcatggggccgcactcgttcactatctcttcgagcgagggtgcgggcacataggcggtggcgagccagggcacggcggcccgcgggtcggcgtcgaccacggcggcggtgtagaacccgctgaccgcgcgggcggcctcgacctcgcgcgtgaagcggacccggaagagctgatcctcggcgagctcggtgcgcaccgtcttgatcgccacccgccggccggacgccgaccgcgcgagatagaccagccccatgccgccggccccgagccgtcccagcacctcgaacgggccgatccgtctcgggtcgtgctgcgtcagctgctccaccacttgcctgccacctccccgtaaacgaacctcggcgacgaagtccgcgaattaccgccggtcgaatcccgccctgcgcggcgcgccctgtgcagggtctcaccactggtcatcacctggcggtacgcaccccgattcttcctggcccggaccccggttgcgaacccgggggcggatgggggtgtctcatgtcacttcgggcggtatccccccacaccgggttacggaaaggggtgcgaggggtgcggaaggcgggtcacggaagcagttcgccgggctggagtacggcgaaggcggccccctggtcgtcgtgcagcacggccatccgcccggaggggatgtcgaagggcggctgggtcacccgtccgccgagctgtacggcgagttcggcggcggcgtcgcagtcggcgacggcgaagtagacgaggaagtagctcggcatctcggccgggaacgcgtccgtgatgacgctgcgaccgccgacagcggtgtccggaccgggttcggtgccctcgggggaccacatccggaagtcgaccagcgcctcggagtcgccggtgatgtcgtggcccgcctcgtccaggtcggtgccgcggaagccgaagaccttctcgtagaagggatccaccttgtccggctgccgggtgtagacctcggtccagcagaaggaggcggggtcgttctgcttctcgaagcccgcgcgctcctccggctgccagagcccgaagacggcgcccccggggtcggccgcctgcgccacgatcccggcgcgccccgcccgtaccgggtcggtgatgatctggccgccgtgctcgcggatcgcggcgacggtggcccggatgtcctcggtggcgaagtagacgccccaggccgtgggcatccggccgtccttcttggcggcgagcgcggcgaccaggcggccgtcgctgagcgcgtccgcgaagggcatgccgtcgcccgcccggaaggtccagccgaagagcccgccgtagaagcgcttgcccgcttcgaggtcggagagctgcacgtccgcccagcacggcgcggaatgcgcgaatgcggccatgggaccgggtccttccgtagcggtgacgcagtgacgcccgtcacagtcaacgtaacgtcgccccccgccccgcgcgccccggagacacggcgaaagcgttccacgcgcacctcggacacacctcggggcgcacggaaagggaacttttgcccgattgatgaaggaggtgctcaccatgtggacgaaagttgtccaccgaagttgtccacaggctgttgataacatttactccggctgcaccccgtgacgcgctccgggctccgaggcctcgcgcaccgcggccgaaaaccaccgctcctcacccctgcgcaccccgctggtcctgcggcgttccccatttgcagtcggccgaatcgcgctcccatcacccctcggtaagctgacggcatgacaggacaagtacgcaccgtcgacggccgcgtggccggtcgacgcggtcaggcgacgcggcagaagctgctcgactgcctcagcgagatgctcagctcctcgccgtaccgggacgtcaaagtcatcgacgtcgcccggaaggccgggacttcacccgcgactttctaccagtacttccccgacgtggagggcgccgtcctcgaaatcgccgaggaagtcgccaaggagggagccggactgaccgaactggtcgccggacgctcctgggtcggcaaggccggctggacgacctccgaacaactcgtcgagggattcctcgacttctggcggcacaacgacgcgatcctccgcgtgatcgacctcggcgcggccgagggggacaagcggttctacaagatccgcatgaagatcctgaactcggtcaccaactccctcacggattccgtgaaggagctccagagcaagggcaaggtcgacaaggacgtcagtccggcggcgatggcgggttccctggtggcgatgttggccgcggtcgcctcgcaccagaagggcttcaccacctggggcgtgaagcaggccgaactgcggcccaacctcgccctgttggtgcacctcggcatcaccggcaagaagccgacgaagtagcccggggcaccggagtcccaccggccccggacgccctcaccaccgggcgggcacccgcccacccggacgccccacgtcctgtctcgccgacggcggaccacccacgcacccctgcgggtggtccgccgtcggcgttcccggaggaagcgccggac

SEQ ID NO: 4105 - DNA, 1337 bp, Unknown
  Kingdom: Bacteria, Phylum: Actinobacteria, Class: Actinobacteria, Order: Streptomycetales, Family: Streptomycetaceae, Genus: Streptomyces
  misc_feature (1150)..(1151): n is a, c, g, or t
cccccatcccacccgcaccaccccacagaacggaatcaccatgagcggcaccaccaccccggccggcacccgtgacgttgtcgacgcgttcttcgcccgcttcggcgaaggcgacatgcccgccctgctggacctgttcgccgacggcgtcgacttccacgtcggcggcgctcccaacgtcccctgggccggcagccgcaccgacaaggacgacatcgccgcgttcttcgcctccttcggccggcacctcacccccgcggaggagtacgccgtcgccacgactgtcgtcgacggcgaccacgccgtggtcatcggccacaaccgcttcggggtcctggccacaggcaagaccttcaccaaccacttcgccctccacatcaccgcagccgacggcaggatcaccggctaccgcatgtacgaggacagccacgccatcagtgaagccttcaccgactgaccctgtcctgcccggctgccgaccggaagacctcgatgcctggccggcctcggaacgtcggtcctccgctcagcagtccgggatcaccgccccgttgttgtcgcgggcctcgtcgttgccccagcgggagaggtagtacgcggagacgtacgcgttgcggccgttcttgcccgcgtacaccgtgtccaggtcggtgcgcagccaccagtggttgaactgggtggccgtgccgacccgctctccccacaccttgcagtacacgtagttcgtaccggcgttcaggacaccctgggcgtcggccgtgttcgcggcggcgtagccggtggcgttggcgaaggtgtcgacccagacccttccacctccgccgccaccgcaaccgttgtcgctggtcaggtacttgctgtagtacgagccgggatacggcgcgagcgactgaccgttgatcacgatgttctggccgacgccgttgtagagctgctcataatggatgtgggcgccggagctgttcccggtggagccggtggtgccgatctgctggccctggccgacctgggccccgtgggcgacggagaacgcggcgaggtggaagtagtaggtcttccagccgccgccgtgctcgatcgcgatgtagttgcccgcaccgctcggctgggagtagcggtaggcggttccggcggccgaggcgaggaccgnnctcgcggcggcggtgacggtgagcaggcctccgaggagcgccagcagggccagcagactggtacgggtcgagcgcatgggcggggaatcctccgggtcgacaaccgggcagtggggtgcgaggtacggagcgcgcggcgcgagatgcgagctgtcaaggcgagccgcgcagcgcgaagtgccgctg

SEQ ID NO: 4106 - DNA, 880 bp, Unknown
  Kingdom: Bacteria, Phylum: Actinobacteria, Class: Actinobacteria, Order: Streptomycetales, Family: Streptomycetaceae, Genus: Streptomyces
cggggggtccgtcccgtggggggtgtcttgcgtgtgcccgggaccaacagggtcattcatgtgatctgcgtcacatctcgctggggtgcctcacccgatcggcacccgcaccgccggcacggtccgaacggcccagccggaccgccacgacctgcggcgaccccttccggcaagggtgccgcgccggtccgtacgggtgaaagctgaccccgcgtcagaaggcgcggcgggcccggcccccgttggctcggggacaggacacacccgctcgcgccgtctgcccggaggatccccatgcgcagtcctgcccgcctcgtgaccggcaccgtcggtgccgcgttcaccgtcatcgcgttcggtctcaccgccgccgctccgtccgcgtacgcgggcgacttcggccgtctggagatcaccccggcgaccgcggcccccggcgccaccgtcaccgtgaacaccaccgcctgcggcaagaagggctcgggcatcggcgacgcgaactccctggacgccggggacttcgaggtgcgtcccggcacccacaaggaggtcgtggtcggccagttcaccgtgccgcacgacacccggcccggcacctacgagatcatcgtctcctgcgacaacggcaaggacgccgtcggtgacctggaggtgatcggcggcggcaagcacgagaagccgatccacgaccgcccgtccggtcatgtgcggaccggggtcggcggcagcgtcgaaccgaactccacgcaggtcgccctcggcgtcggcgtgatcggcctggccgccgtgggcgggctgtggctgctgcgccgccgctccgagggcgccgaaggaagctgaaccaccgcttccccctgaccgggcggggcgcgctcgggga

SEQ ID NO: 4107 - DNA, 2294 bp, Unknown
  Kingdom: Bacteria, Phylum: Actinobacteria, Class: Actinobacteria, Order: Streptomycetales, Family: Streptomycetaceae, Genus: Streptomyces
tggctggacagcgaggggttcaccgaggggtcggacgagacaagggtgttcctggaccgcctcgcgcgtacgtcgcacgcggcgggccggccggaggccgcggagaacatccgcaggcacatgcgccggaccgaccacgaggacggacgccctcctgccgactcctcggagaccggtacggaggatcccccgctggccacacccgcctcctggccgccgaccccgcacggcggagacgcggccggccgcccggccgacgcggcggaaccatcgagcaccgggagccggccgacggcatcggaaggcacggccgccgaagcgggcggtcccacccggcagttcgaccccggcggatgggcgcagagcggccccggcccggagtggcccggggacgaccgatgagcttgtgcccgcccgtcgatgtcttcacccgcatctgcaggtccgtggagcagcggtacggccagggacagccgctgtgcagtggttcggacgcacccatggagccgcactgcggtcgagtgggtatctcgctggacgatctgcgctcccaggccctccgagcagagccgggccaccccgaccggatcgctcactggcggcacattgccggccacatccggcagaacccggagggcgaggacgaggatgagggcgggcgaagttggacgcttgtcgctgtgtcgctgctcgcgccccgcttgagaggagcggcgtactcgctttcccgccgtaccggggccgagcacgccgatgtgtgttccgccttgctgcaaggaatgttggagggtgtacgaacccttggccgggcagacgcatcgctcgctgagcagcacctggtcgatgcggccttcgccgccgggtggcggaccggccgccgcagtccggaggagaccccggtgggagagtggggatcggtgcaggagcaggaatggcccgaaacgttgacgatcgcggccgatgaagtcgtacgcgtcgaggggatgtccagaaccctcgcccagcaggcacagggcgaacggctgggctcgctggcgtaccgactgggcttgctggaccacgtgcgccaggcacgtcagcgtgggcgccgccgagcgggccctcgcgtccagaccgcagtgagcgggcagttgggcctgttcgagattcgggggtccgcccgatgaagcgccatcgtgatgagtcggtcgccttctccgctgtgttcgaacttccggaggaggtggggatgcgcatggcggcggacgcgctgagcctgggtctgagtacggcgtacaaacgggcgagaaggggtgaattcccgtgtcctttaaggaaagtcgggcgtctgtacgtcgtgcggctgacggacctgatgcgggctctcggcattcaggacgtgcgcgtgcattacgacgacttcgaagcaggtgcgcgcatcgcgtgtggccggtccgacacctggcactgagcaggggagggccggggtggcgcacgggagggccgtgcgccaccccggcaaccggatcccgttcacggcggcgtcgaagacatgggcagaactcgtcccactgggcgctcggtgcggacaggcagaccacgtactgggtcccgtcggcgccgatgaacgccagttccgccgcacggagatcgcgtacgcgttccttgaacctgaactctcggtatccgcgcgctgtccccgggcgggtgtctcgtccatccgtacccgctcgtagcccgggttgtcgcgacggtctgagtctcggtctcgcgcctgtgccggagtgggtccgtccgcgaacgtggcgatgtcgcccaggcccgccagcccggtggggtcgctgctgggagccgagccgtcccggacgggaacgaagaaccttgatggtcctccttcggccggtatcccggtgggtggcgggggctgggcagagacgctgggttccggggcccggtgcgagcggtcgccttgggtggcggcggagtgggcgtcgccccgggccacagcacgacgcccgccctttcgcgcggtggcgggaggctcgtctcgttcccgctgggtgggctgatcgaacgccgtcggacctgcttgctctggtgcccgcacccgggttccctgcccctgcggcgcggatcgtacgggtcagtggcggtggccacagggccctcgcggaactgggctcgctatgcccgctccggagacgttcggaggcgggcagcggaccgacccacgagctcgccgagcaaggaagagtgccgttctcattcggcgtcggagacctgtgccggaaacgtcgaaggcccccgcagcgagc

SEQ ID NO: 4108 - DNA, 5029 bp, Unknown
  Kingdom: Bacteria, Phylum: Actinobacteria, Class: Actinobacteria, Order: Streptomycetales, Family: Streptomycetaceae, Genus: Streptomyces
agccaggacgtctaccgggcggcgtccgacctggccgcccgtgccgcgcggctggccgagggagtggcggcctcacgggcggtacaccgcccgcagcaggggcagctcgcagcccgggccggggtgaatgtggccaacgaggcgtacctcgtaccccgggaacacgcggcgcagttccatcgggatctctccgcactggccgaaggcgcccccggagtgtcgatcgaggtgaccggaccgtgggcgccctactcgttcgccaccgcgatggtggcggagggcgcggacggcggtggcccgcggtgagcacggacatcgtcggcggcgttctcggagagaccgagccccggggcggcccgcccatcgccctcatcgacctcctggaccgcctgctgaacggcggggccgtgctcaccggggacctcgtcctgtccatcgccgacgtggatctcgtccacatcaatctgcgagcggtgatccggtcgatcaccggtgaggagccggggccgtggtgagccccccggtcccgtacgggcgaggcactccggcgagcgaggaggaggtggacacgatgaccgaggacgaccgcgggcgaggtgcggagggcacgcccgccgcggcggccgaagaggtggcacgcgccgcggcccgggcatgcgggctcagccccgcgcgaccggacgaccgcagcccctcggcggcggcccagcggctgcacaccgacccggacaccgtggagcgggatctcatcaagctggtgctcaccatcgtcgaactgctccgccagctcatggagcgcaccgcgatccaccgcgtcgagcagggagacctgagcgagccgcaggaggagcggatcggcatgacgctgatgatcctgcacgaacgcatgacggagctgtgcgaccgctacgacctgacgatggacgacctcaatctcgacctcgggccgctcggctcactgctgccgcacaacggcgcatgagcgggccgagcccaggtttcatcgcatcacccaaggcaaggaggaagccatgactgacgacaaggaagcgaagaactcgaccccgaacaagggcaggaccaccaccgcccgcaaggcggcctcggcccgcaagacggccggcaccacggccgagaggcacggcaagcgggccgaggcgacggccgacgaggcgctgtccgcggccgggagcgccaaggacgcggcctcggacggtgctcgggcggccggtgagaccacccgccgcgtcggccgtgccgctgccgccggtcttcagagcgggcagcacgccgtgaccgccaacgcggcgaaggccgcgagcgccgcgaccacggcctggaccgtcgtcaagcaccgcaaggcggtcgccgccggagccgcggcgggggtggtaggtgtcgccggagcggcgttcgccatcggccgttcgaccgccaggcctccgacgggcccgctgacccgactggcgcgcggtcggatctgaccgaggagcaggagaacgccgggcccgggcacgggccaggacgtggggcggggccggagaggattctccggccccgccccacgtccggaccacggcgccttcgggggcgtcgccgcgtcgatcatccgccccggtcccctccaggccggcagcaaacaccccctgctccgccggcggcgcggcgaggagacggtgacgtatccccacccgctcgcgaaagccgcgctggagccgaccctcggcgtcgccctctggcaggaacaggccatgcaactcgcgatcgactgcgcggggttcagtcccggtgagaccgaccggctcagttaggcgatggcggccacacgtcccggaggagaccgccgcgatgcgcgaccgcctgctcaccggcatggtcggccgcggcattcccccggccgccgccgagaagatcgtctcgatgatcgaggccttctccgactacggacttccccggcgccacgtcaggcggcgccaaatcctgtcgtcacacatgcccggagcctatgtcggccgcactgaacgcgatttccgcccatgatcatcagatgtggtgaacccgcggctccccaggggtgatacgcccatatctcccaccatgatgaggtcgtcccgcccacctccccacaggagatacgacgatgtcagagacgcccgagcccaatgtcggtgccttcaccctcggcggcccgctcaccgttgaaccggccggtcccatcgaggtgccggagcacgaggagtggcccctgccgaacggcttcgcgtgggtcttccccggagagggaaacagtgccaacctcgtccggcccgtgatcctggccgacggcttcaacctcggccggagcaagctcgacgtgctctaccacgggctggagagcggcagcttcccgttcatcagcgagctgcgccggcgcggcagggacgtgatcctcctcggcttcgaggagcgcagcgcgtcgatcctggacaacgccgaggcggcggtggccgccatcctgcgggcgacggccgagcaggtgggcgacacccgtctcgtcgtcggcggcttcagcatgggaggcatcgtcacccgctacgcactcgccaagctggagaggcagcggatggaccaccggaccgcgctgtacttctcctacgacagcccgcaccgcggtgcttccatcccggtgggcgtgcaggcgttctcccacttcatcccgttcccgaacgacttcgcgaggcagatgaacagcccggccgcgcgccagatgctgtggcagcactacgacaaggacaccgagaagatcacggtcgccccggagcgcacggagttcctggcagccctggaccgggtcggcaactggccgcagatcccgatgaagatcgccgtggccaacggccgcgccgacggcatcggtctgccggacgtgaagcccggcgaggtcgcgctgcggatcgaccggatctaccccggcaccaccttctacacccaggcccagggcgacgacgtgacggccgcgtacctgaaccgcaggttccccaaggccgagaggaccgtcgcgaccaacggcttcccggaactggacggcgcgccggggggaaccctgcacacgtacaagatcctctccggggcgatggagaagctcggcggcaagatcgacctgcggcacgaggacgtctgcttcgtcccctcggtgagcgcggtagcgatccgcgacatcgagaagcaggacgacctgtacgcgaacatcgatgacctggacccgcaggagagcgaactcgacgatttcctctgctcgtccacgaccaccgcgcacacgggcatcaccgaggagctgtgcacctggatcatggaccgcctccccggctgatccccgaacagcgcgtgggttgacgggtgtcgaggaaacgcacggccgggcggcgtttcctcagccgccgaggtgttcggcccggtgcgcggcccaacgctgcatcagcgaaccgagctccttctccaggaaccggaagaactccagcgtgtcgttgatccggcgtccctgcggggtgtcgaggccgaactggtccacgccctcgcgcatcgtggcctgccagttcttcaggagggtgtcccgctccagcagcgcgtcgtaccactggtcgccctgcacgcgatagcgctcacgccgggaccccggctcccgctcgcggctgaccatgttgacctgggcgagatagcggacggctcccgacacggccgccgggctgatcttcagctgctcgctcagctcggcggaggtgagtgctcccgactccgacgagagcagggccgcgaagaccctggcgggcatgcgggccatgcccgcctggaccagctgggcggcgaagcgctccacgaaccgggagacggccgcctcgtcgtcgctgccgtccacgcggctctctttccgccgctcatccatgctccgaccccggtcctgtggttcctgacacgctcgtgcccgcccgcgtcctcggccagtctatcgagtgattcatacggtttcttaacttcacacatttctgaaagaagcgtactttcggaatatgaagaaggcaatcaccgtcgccggactgcacaagtcgttcggtgggacgcacgccctcacgggcctcgacctcgccgtcgaagcaggtgaggtgcacggtttcctcgggcccaacggggcgggaaagtccacgacgatccgcatcctgctggggctgctgcgcgccgactccggcagcgcccaactcctcggcaaggacccgtggaaagacgcggtcgagctgcaccggcggctcgcctacgttcccggggacgtggagctgtggccgggcctcaccggaggcgaggccatcgatctgctggcgaagctgcgcggcggcctcgaccggcgccgccgcgacgaactcatcgaacggttcgacctcgatccgctcaagaagggccgcgcctactccaagggcaaccggcagaaggtcgccatcgtcgccgcgctcgcctccgacgccgaactgcttctcctcgacgagcccacggcgggcctcgaccccctgatggaggtcgttttccaggacgtcatcctgcaggcgaaagcggcggggaagaccgtactgctctccagtcacatcctggcccaggtcgaaaagctctgcgaccgcgtcagcatcgtccgccagggccgcaccgtgcagtcgggcacgctcggcgagatgcgccacctcacgcgcacgaccgtcgaggccgagaccaagcgtccggccaccgggctcgacgccgtgtccggtgtgcacggactgagggtgacggaccggagggtgaacttcgccgtggacggagcacacctcgacgccgcgatccgcaggctcggcgagttcggcatccggagcctgaccagccatccgccgacgctcgaagagctgatgctgcgccactacggcgacgagctcgcgtccaacggccgtatggggaacggcgatcccgcctcctccggtgcgtcgtcgtccggcgggggcgacacccccgacacggcggtcccctccgccccctc

SEQ ID NO: 4109 - DNA, 2104 bp, Unknown
  Kingdom: Bacteria, Phylum: Actinobacteria, Class: Actinobacteria, Order: Streptomycetales, Family: Streptomycetaceae, Genus: Streptomyces
tcgcacagcacctcggtgtcctcggcggccccgatcacgcggtcgaagcccggcaccacccgggcgatgcccggcgcgggcccgaagcgcgtcgtgcgggcgacgcccacggtgcgcaccccgcaggcccccagcaaccgtccgacggccgcaccgatgcggccggtcccgtagatcagcgccgtctgcccggcgaccagctccggggggagacgctcccagtgcgcgcgggcgtgccggtcgatgaactccggcacggactggcactcggcgagcatccaggccaggacgtactgggccatccgctcgcccatccgtcccacggtccgggtcaggagcgccgagccgggccagggacccccggcgaacagcgggtccgtccccgcgttgacgctgtggaaccagagcagacggctcgtccgcagcgcgtcgggcagcgtctcgcccacgcacagaaggggtgcgtcggacggtggtgggacgtcctccagcggctccgcgcgccgcccggtgatccgctccagctcccgcaccaggccgccgtcgagcgagggcgcgaccagcagccgggccttcacgagggcgtcggccgcgggcagcggggtcggcacgggcatcccgcagccgaggaccgagtagggctgtcccgggacggctatcggcggaacgggctcggtgctcccggtctccccggtcatcgcgcggtcagctccccgatgcgaggtgggccgggaagccgccggtggcgacaggaccccagcgctccggggtgacccggatgatcgacttgccctgcttcaccatcgccgcccggtactcgtcccagtccgggtgctcgcccgagatgttccggaagtactcgacgaggggttcgaccgagtccggggcgtcgatgacctccgccgaaccgtcgacctgcacccacgggccgtcccactcgtccgacagcacgatcacgctgacccgctcgtcgcgccgcgcgttgcgggtcttggcgcgctcggggtacgtcgacatgacgatccgccccgagtcgtccacgccgcaggtcagcggggagccctgagggcggccgtcggcccggacggtgagcaggaccgcccggtgccgggggcgtacgaacgccagcaactcgtcgagttccacggcggtgttggtcgcgatgttcggtgccatgcccaccaccctacgaccgggtcaggtcactgcccgggcagcgcctcgccctgtaccgcctggatgtccagctccacgcgcagggtcgtgccgatcgcggagatgcccgcctggacgacctggttgtagttcatcgcgaagtcggcgcggcggagttcggcggtggcgtggaaggccgcgcgcaccccgccccacgggtcgggcccggtgccgaggtagctgaggtccagatcgacggggcgcgagacgccgtgcatggtcagctcgccgtgcacggtccagcggtcgggtcctgccgggtccagtgcggtggagctgtaggagatctccgggtaccggtccacgtccaggaagtcgggagagcgcagatgcttgtcccgcatctcgttgccggtgtcgatgccggccgccctgatcaccgcgtcgacccgggagcgggagacgtcctcggcgatctcgatgcgtccgccgaagtcggtgaaccggccgtgcacgctggagatccccaggtgctgggcgaccgcgccgaccgaggagtgcgcggggtccagcgaccagacgcccggcggcggcagctccaccccgccctggcgggccagcacgatctggccggcctcgatccggccgctcgcggtgacgagggcggtggaggcggcgggcgcgtacccgaccgccgtgacgatcaccgtgtacgcgccggccgtcagggaaccgtccgtgcggacggccccgtcctcgtcggccgcggcgcgcagcacctgggcgccggtcatgtcggtgacggtgacgacggcgtgctggaccgcccagccgtcccgcgtccgtacctgtgcgcgaagtcccatcccgtatctctctcctagctcgatgacccgcggccggcccgactcatgcggccccgggttccttcgggccggccgcgggtcat

SEQ ID NO: 4110 - DNA, 587 bp, Unknown
  Kingdom: Bacteria, Phylum: Actinobacteria, Class: Actinobacteria, Order: Streptomycetales, Family: Streptomycetaceae, Genus: Streptomyces
  misc_feature (252)..(310): n is a, c, g, or t
gtcggcaagtacatcgacctgcccgacgcctatctctcggtcaccgaggcgatccgcgccggcggcttcgccaacagggcccgggtcaaggtcaagtgggtcacctccgacgactgccggaccgcggcgggcgccgccgagcacctcggcgacgtcgacgcgatctgcatcccgggcggcttcggcgagcgcggggtcgacggcaaggtcggcgccatccgctacgcccgcgagaagaaggtgccgctgctnnnnnnnnnnnnnnnnnnnnnnnnnnnnnnnnnnnnnnnnnnnnnnnnnnnnnnnnnnncgcgggagacctgggcggcaccatgcggctcggcctctacccggccaagctcgccgagggctccctcgtccgcgaggcctacgacggccagccgtacgtggaggagcgccaccgccaccgctacgaggtcaacaacacctaccgggcggagctggagaagaaggccggactggtcttctccggaacctccccggacaacaagctcgtcgagtacgtcgagtacccgcgcgagacgcacccctacctggtcgccacccaggcgcacccggagctgcgc

SEQ ID NO: 4111 - DNA, 1278 bp, Unknown
  Kingdom: Bacteria, Phylum: Actinobacteria, Class: Actinobacteria, Order: Streptomycetales, Family: Streptomycetaceae, Genus: Streptomyces
gccatcatcggccggagcgcggcgagttgttcggcggtggtgtcggggcgggggtgttcgtcggcggtgacggtcgtctcgcccttgcgggtgcgtacggtgacggggacggtctccgcgtcgtagcggccctcggcggcggcgcggccggcgcgctgttgggaccgcagggccagggcgtcctggtcggcgcggctgatcccgtactcgcggcgcaggttctccgccgtctcgatcatgccgccggggaccgggtggttgaggcctccggcggtgacgcggccccgggcgagtgcgtcgtggagctggaggccgggacccttgatgccccagcgtccgtcgtgggtgtagtagggggcggcgctcatcacgtcgacgccgccggcgatcacgacctcgctgaatccggtccggatctgcatcgccgcgtccaggaccgcctggagtccggagccgcagcggcggtcgatctgggagccggtgaccgtggtgggcagcccggcgtccagggcggcgacccggccgatggcgggggcctcgctggtcgggtaggcgtggccgaggatcacctcgtcgacccgggcggggtcgatgccggtgcgggtgacgatctccgcgatgacgcgtgcggccagcgcggccggggtctgctgggcgaaggccccgccgaaacggccgatgggggtgcgcaggggttcgcagatgacgacgtcgatcggcacggcggggccttccttcagggcgacgggctgggcgcgggtgatggggtgacgggtggtggggtgaccttcgcatccggcgactgagtcggtccaataccggatgtgccccgtatcgagaggcccggcgtctcaatggctcctccgcccggtccgcgtacgggggtcggcagggcgtcccgggcgacggcgagcacggcgtgcagggcggccgaggggttgtcggcacgccaggccagggccgcctgccggcggatgggcggtccggtgaggggccggtagaccagtccgctctgctggatgtgccgcacggaggtgaccgtgagggtgatgccgaccccggcggcgacgagcgccatgatcgtgtacgagtcgggggcctcctggacgacgcgcggggtgaacccggcgctctcgcatgcctcggtcatggcgtcgcgcacggtggagccggagttggcggggaaggagacgaacgcttcgtccgccagctcgccgagcggcaccgcctcgtaccgggcgagcgggtggtcgaacggcagggcgcacagcagctcct

SEQ ID NO: 4112 - DNA, 897 bp, Unknown
  Kingdom: Bacteria, Phylum: Actinobacteria, Class: Actinobacteria, Order: Streptomycetales, Family: Streptomycetaceae, Genus: Streptomyces
ggccgggcgccagggcccgggggtgctcacgggttccggcctccgcgaagggggccggcgccgtcggggacgggtcagcgcagcgcttcgaatacgccctggctggtcttgctgttgagcacctcggtgaggtcctggttctccttcgccagccggtcggcggacgtcacgttctcctggagcgcgtcgaccatcttgctgatctgcacgacgaccttctgcgcctcgccgttccagctgcggaacagcttcagcagggcctgaccctcgtcaccgccgacgcccgaacgcgcggcgatctcggcgacgttgttctggatcttctcgaccgcggcccgggccgactccagcgaggagacacctcccaagcccttggcatagtccgcccgcctctggccactgtccgccatgtcgcgctcccttcgttgagtgacttctcgtcgcaccgttgcacgctgaggctaaagagaactcgccttccgccgcaacgtatgcagggaagatttgagcatagttccgcgggccagattccttgcgtgccaacggagttgtccgaaggtttccacgaaatgaacccggcccgcccgccgacgtccataccggtcgatgcggacggcaaacgggcagccggagaatccgaacggtcatcgaggcagcccgtttccgatgcggcgtgcccctttcgcgggattcccccggagaggtcggcggccaaacttctgagctttttctgaggtttacctccgcgcgcggcacaccccgaataggccctcgccgacgccgagtcgtgtgcgaggttccacgtcacacccatttctcttttttcgacaccgtatgagggatttcacccggatcatggccgggagtcgctcgtccgcgccgtgccggaggcgccgc

SEQ ID NO: 4113 - DNA, 1251 bp, Unknown
  Kingdom: Bacteria, Phylum: Actinobacteria, Class: Actinobacteria, Order: Streptomycetales, Family: Streptomycetaceae, Genus: Streptomyces
tggtggacggccgcggccgtccaccagaccggtctggcgggccagctggtcaccgcccgccaccacccgtacgacatagcgcgagccgcggcgcagtccgccgggggccatcacgatcagctccgagctgtgcccgaagatctccaggatgtcgcgcttgaggcggcgggcggcgttgccggtgtccagctccgcctcgatcacaatccggccgctcaccaggtgcaggccgcccgcgaaccgaagaatcgccgagacctctgctttcctgcagcaggtccgggtgacgggaagatgagagatttcgttcttcaccgctggcgtcatcgccatgggccgatccttccatgcatccgaaaaatacggtcgtacgcggcggccaacagctcctgatcatggaccggaacgccgtcgggcgatgccaccggcgccagctcgaccgcggctccgagccgtagcgcggcatcggcgagtgactcacggtcgggcacggcggcctcatcggccagcaccacgtccaaggcgagtttaggggcgtgtcgccccaaaacctccaaatgacgctgcggtgagaagccttctgtttcaccgggctgcggtgcgaggttcaacgagaggaccttgcgggccttcgtggtgaccagcgcgtcgagcagttccggcacgagcaggtgcgggatcaccgaggagaaccaggagccgggaccgagcaccacccagtcggcgtccaggaccgcctccacggcttccgggacggccggcgggtcgggcgggaccacgtgcacggactgcacctcgccgggcgtgagcgccaccgttgcctgaccgcgcacggtgacgatcgcgtcgggcagatcggggtcatggcctttgaccagcgcctggagctccagcgggacggccgacatcggcagcacccgcccgtgcgcgccgagcagcttgccgaccaggtcgagcgcctggacatggtcgccgagctgctcccagagggccacgatcagcagattgccgacggcgtgctcgtggaggtcgcccttggactcgaagcggtgctggatgacccgggaccaggtgcggccccagtcgtcgtcgccgcacagcgcggcgagcgccttgcgcaggtcgccgggcggcagcacgcccagctcctcgcgcagccggccgctggaaccgccgtcgtcggcgacggtgaccacggccgtgaggtcgccggtgatccggcgcagcgccgccagggacgccgacagcccc

SEQ ID NO: 4114 - DNA, 1079 bp, Unknown
  Kingdom: Bacteria, Phylum: Actinobacteria, Class: Actinobacteria, Order: Streptomycetales, Family: Streptomycetaceae, Genus: Streptomyces
ggcggaccggccagcgtcgagcggccgcttcggcacccgggtgcaccacgacggcgccgggggccggtgaggggcaggccggcggcggcagccggacatcggtgggatcagcatcgatgccgtacgcctccaggagtcggcaccagcgttcgcgctcgtgatcctcccgccgccacacgggcggcgcagccggcgcttcgggcgtggacggggaggcgtacgcgatgatgcggcgcggtccgagggcggagagcgcggcgaggctctcgggtccgttgccgtgcaggtcgacggcgacttctggcgggtccccgtgccagcccgcgaggacgggcaccccgcgtccgggcgcctgggccgggaggacgccgtcgacagctcccgtcgacagggccgcgtcccgcaacgaggcgggcacggcgagcacgatctcgtgcccggtgtaggcgcggcgcagggccttcagggcaggcacagcggtgagcagatcgccgagcccgagggcgcgcaggacgagtacccgggggcgggcggcgggcatggctgtcacctcccggccgcacgggcgcgtccgacggaccggtccaccggatcgagtgccgccttggccgcgagttcggtggtggaacggccgtcgaggtaaggcaggagtacgacctccccgccccagctgcccaccagtggcgcctcgggaagctgagcgagtgcgtagtctccgcctttcgcccagatgtgggggcgcagctccttcagcagccgctccggggagtcctcgtcgaagaccgcgaccgcgtcgacacagctcagggcgcggagaacccggacgcggtcggcgaccggcacgagcggcctggtcgctcccttgcggcggcggacggacgcgtccgagttgacgcacacgatcaggcagtcgccgatgcgccgagcctcttggagcagggcgacgtggcccgcgtgcagcaggtcgaagcagcctcccgccgccacgacggtgccgccccgcatgcggacccggtcggcgagcagtcgcggttcgggctgggtatcggtctccggggccggtggggccgggtcctcgt

SEQ ID NO: 4115 - DNA, 714 bp, Unknown
  Kingdom: Bacteria, Phylum: Actinobacteria, Class: Actinobacteria, Order: Streptomycetales, Family: Streptomycetaceae, Genus: Streptomyces
gagcagccgggccagccgcgacgcccggtcgtccagctcggcgtaggacacagcggtgccctcgaagcggacggccacggcgtccggagtagcggcggcctgacgctggaaggcgtcggcgaccgtgccgcggggaaccgcgaccgcggtgtcgttccggtgcacgaggagctgctcgcgttcggccgctgtgagcaggtcgacgcggccggtgggctgcgccgcgtcggcgacgacggcgtcgagggccgagaggagtccgttcaggaaacgctcggcgcgctccttgccgatgaggtcggtccggtagccgaggcgcagttgcaggcggtcgccggggacggcgatcagggtgagcgggtagtgcgtggtgtcaccgccgtcgatcccggtgacgcggagccgtccgtcggggctgcccaggtcgagggcgtcgaccgggtagttctcgaacacggcgatggagtcgaagagttcgccgtgcccggccaggcgctgcacgtcggtcagccggacgtgctggtgcggcatcagccgggcctgctcgtcctgcacggccgtgagcaggtcggcgaggctgtcggcggggcggacccggacgcttaccggcagagtgttgatgaacaggccgaccatgtcctcgatgccggggaggtcggccgggcggccggagacggtggcgccgaagacgacgtcctcgcggccggtgagccg

SEQ ID NO: 4116 - DNA, 2763 bp, Unknown
  Kingdom: Bacteria, Phylum: Actinobacteria, Class: Actinobacteria, Order: Streptomycetales, Family: Streptomycetaceae, Genus: Streptomyces
gtccgtagccgtcggccaggacgcgcagccggtgcgacgggtcgaggccgtcgcgaccccgcatcggcgcccagtagcgcgccgtcatggccacgtcccacacccggcggccgggcgccgccaggtcgaagtcgatgagggcggcggcgcggccgtcccggaacaccacgttctccaggcacacgtcgttgtggcagaccaccgcgccgggagccgcggccccctccgggtcggccaggtcggcgggccagcctcccgccccggacggaacggccgccgccgcgtcgtgcatgcgccggagcagcgtccccacggagcgcaggacatcgtccgtccaggtacagggcgggtgcggagcgacggagacctcgccggggacgtacgagagccgctcgcggcgcccggaggcggagactcccagcggcacgggcacgccgtcgaacccctgctcccggagggaccggaggtgggcgtgcaggagggcggcgtgcggtggggcgggacgttcgacggcttcgccgcggcggaggacggctccggcgttggccagtccaccggacaacacctccgggtccccgtccaccgggctcaacgcgcccgcgcggcgagctgccgcacaccgtccgccgcctccgcgctccccgcatcctcggagcacggtcccaacgcccttcgcagatccgccggttcgcgatagaggacgccggtcatgccgagggcggacgccgcgtcgacgttctcctgccggtcgtccacgaacagacaccgggccggcggtacgcccgcccggccggccgcgatgcgatagatggccgggtcgggcttggccacctgctccaccgcgctgttcacgaccgcgtcggccaggtcggtcaggcccaacagggccagatccgcgtccagttggagggtcgcattggtgacgagcaccagagggacatgggtcctggcccggcgcagcagcgacaccgcctcctcgtcggcccggaacggcgcgtccgcgagcgcccggcccagtgcgcgggcccggtccacgcccacccggtccgtgagcccggcggcgatggcctccacccaggcggccggggtgatccggcccaggagcagcgggagatcgacctcgggcgcgtaggcgatgtccgtcgtggtgccctccggcagcccggcggcccgctccagggcggcgagcggggcgatgtcgtagaagcggacgacgttgtcgagatcgcagagcacggcgtcgaaggcgcgtccggcggggaccggtgagaccccaggaggtgccggagtgccgccgtcaccgggggcggatcgtgtgcacatgcttggtccggtctcctgcggtggcctgggcgtggtggtgcgtggtcgaccatgaacggccgccggaccgttcatggccgaccactgccgcccttgcgggcggcccgcaggacgtcacgcgtcaccgcgcgtcccacacttggcggcggtcagccggtcagcgcccgccaggtcaccgggcccgcctcgccgtcggccaccaggcggttgacgctctggtaggcgcgtacggcgctcgtggtgacggaaccgaacccgccgtcgaccgccagtcgggcgctgcgcttgttcagtgcggtctgcagggcccggacgtgggacccgctcgcgccctgccgcagcgtgtacacgagtgcgggccaggtggccggcccgacctggccgtcggccgccaaccccttggagcgctggaaccgcttgaccgcctcgacggacacggagccgtactgtccgtcggcggccagcttgtggccgcgctggttcatcaggtgctggatcaccacgaccgtggcgccgctcgcgcccgggtcgatcctcgaccagccgccggagaggtccacgccccgggcggccaggaaggcgaccgggttcaccgtggtgccgaggcgtcccgagtgggtctcgaagtgcaggtgggggccggtcacattgccggtggcccccatgtcggcgatgcgctgtccggccgagaccttggcgttgagaccgacccggtaggcgttgaggtgcccgtaataggtgtactggtcgttgccgtgcgagatcaccagggcatgaccggtccggcccggcaacccccctccccacgaccggcggacgaccgtgcctccggccgccgcgtggacggcggtgccgatggagttactgacgtcctgcccggcgtgggacgcgccaccccggggcgcgccgtagtggcccccggccgggaaccggcccagggcgggattggcccacgccccgttcttcgccgtcgccgccgctgccgtggaggccccgatcgacaggttcatggcgagcgcgcccaggcccaggcccgccagcagcccccgacgggacaggccgtggtccggcctctccaggtccgccggtatcttcgtcggctcggcggcggtcgcacaggatcggcacatcatgtctccctcgaagcgggtcgagcacgtgggtcgggtcgagcacgtggagcacccgggcgagcgggtgcgggggatcggcgggtaggaggatctacccgcatagacgatagggcccggcggctgcccggtcaggggtccacgggcccagagggggacccaacacgcgtatgcgtgagccgagttccgtcagaacccggcgaggccgacgagcagctcgacggcgggttccgggtggacgggccggcgcggatgactgccttcgggcgtccggacgtcgaaggggttgtcgggggtgagcgcgccggcc

SEQ ID NO: 4117 - DNA, 1299 bp, Unknown
  Kingdom: Bacteria, Phylum: Actinobacteria, Class: Actinobacteria, Order: Streptomycetales, Family: Streptomycetaceae, Genus: Streptomyces
ctccagcccgccgcgggcccggagaccggcgtgggcccgatctcggccgccccgtggggctcggcgggcattctgccgatctcgtgggcgtacgtccgtctgatgggcggcgagggactcaagcgggccacgcaggtcgccgtgctggccgcgaactacatcgccaagcgcctcgaaccgcacttcccgatcctctacaacggcccggccggtctggtcgcgcacgagtgcatcgtggacctgcgcccgatctccaaggcgaccggcgtctccatcgacgacgtggccaagcgcctgatcgactacggcttccactcgccgacgatgtcgttcccggtggccggcacactgatgatcgagccgacggagagcgagaacctcgcggagctcgaccggttctgcgacaccatgatcgcgatccgcgccgagatcgagaaggtcgcctcgggggagtggagcgaggacgacaacccgctgagcaacgccccgcacaccgcggccgcgctcggcggcgactgggaccacggctacagccgcgaggaggccgtcttcccggccggcgtgtccgccgcggacaagtactggccgccggtgcgccgcatcgacggggccttcggcgaccggaacctggtctgctcctgccccccgctggacgcgtacgacgactgagacggaccgcggcagggcgtgcgccgtgagcggtgcgcgccggacatgcgtcggggccggtgcggagatctctccgggccggcccctgttcgttgagccgtcctcaggcggccttcaccacgcggccggctgccagtggccggtgcggggcgatgatctgcccgtcgggcagcagttcgccggtgtcctcgaagagcaggacgccgttgcacagcaggctccaaccctgttcggggtggtgggccgtcaggcgggcggcctccctgtcgggtgaatcggcggtggggcagggtggctggtgctggcacatggatgggttctttcgctgcgtcgagtcgagtgtcctgcggctggatgagtcgttcatggccgcccccgtatcagtcggtccggtcccagtgttgccctacggggaagattccgcagggatttcgctgcagcacccgtactcctcccatgacgcatcacccgcgcggacggttcatcgcaactgcactgtccctttgggtggttcggggtggccggatggggctagtccgagtgggcagcagaccgcccccgcagtgatcctttcccccgcccggcgttcgggcaggggtcagggtcgctacgggggcggtctgccggggt

SEQ ID NO: 4118 - DNA, 4841 bp, Unknown
  Kingdom: Bacteria, Phylum: Actinobacteria, Class: Actinobacteria, Order: Streptomycetales, Family: Streptomycetaceae, Genus: Streptomyces
ctggtgccgggcggcccagtagccgagggcgtgggccagctcccggacgcgcgggacgctctcctcacccgccagcagggtccgtacggaatggcccacccggatcgccggatgcgtggcgcccgcggcgatgcccggcagcagccggggccaccactcggcgagcacggcgcgccaggggcgctcggccgtctcgcgctcgaagtacaccgtccagtcggcgatgcggcgcgggtcgcccagcgcctcgtgccagttccgcgcggtcaccggggagccggcgtccggcatctcctccagcttcgggccgtaacggtccagccagcggtgcacggccgaggcctggccgtgccgcacgagggcctccacggccatcggcgcgtgattgctgagccagccgtcgcgctccggtcccgagacgtggatgcgctccagtgcctcgtcgagggtgcctgtggtgtcgtccatgccgatcacgctaggcgcgcgcgggccggagcggatcggaccgcggtcccggtcggtctcggaccggggtcccaggtactccgggcctcggttaccggccggatcggtcggtggtcgtacgtcccggggaccgggcccctctcggtccggcgcggcgcggacaccccgagcgacccgtccggcgcggcgcggggaccccctgagcaacccggacgccgcccgatccgtcttcagggtgggagcacggccctccgggcgccgggtggccgggtgacgggggaagtgggcgcgtatgtgagtgcggtctcatgcacgcgccgattccgggtacccggccggagagccgcaaagggatcggatcgtccccgcccacggctccgacctgcgcgtccggcggaatccggaagcggcatccagcggtcggcgccggacagggtactgcatgatcacgaaagtgaatgtgctgcatgggaattctgtccggattccagtcgttgtttccatcggatgcagggcacctcgaaagggtgtcgcgacctactcagcaagggagcacgcatggcaacccgtgccgtcgcccgtcgtacgtccaccacttccggtgggtccggccgggcaggcagtgttcgcgccgcgggcggggaaatcgccgatcgcgacctggtcggcatgtacctggacgagatcgcccgcacaccgctgctcgacgccgccaaggaagtcgacctctcccagaccatcgaggcgggcgtcttcgcccagcagatcctcgacggcgaggtggagagcgccgccggtgacgcgaagcgtgaggagctggaggcgctggtcgccgagggcgagcgcgccaaggacatattcatccgttccaacctccggctcgtcgtcgccgtggcccgccgctacccgcgcgcggggcttcctctgctcgacctgatccaggagggcaacgcgggcctggtgcgcgcggtcgagaagttcgactacgccaagggcttcaagttctccacgtacgccacctggtggatccggcaggccatcacccggtccatcgccgaccagtcccgcacgatccggctccccgtccacctggtggaggagctcggccggatccgccgggtccagcgcgagttcaaccgcgagcacgggcgcgacccggagcacgcggagatcgccgccgagctcgactccaacgccgagcgcgtcgggaacgtcctggactgggcccgcgacccggtcagcctcaacatgtccgtggacgacgacggtgacacccagttcggcgacctgctggaggacacctccgccgtctcgcccgagcagtccgtgatgaccctgctccgcagcgaggagctggaagacctgatcggcaagctcgacaacaggaccgcctcgatcatcaagatgcggtacggcatcgaggacggccgggagcggacgctgaccgaagtgggcaagcagcacggcctcacgcgggaacggatccgccagatagagaagcacgcactgctcgaattgaagcgaatggctcacgacacgggctttgacgctgcggcgtgagccaataacccgtaatctccccatcaagccggttcgcaccggccgaccgaccgggtcattccggtcacccgaccggtttttcaccggtccccgagctgagccccggcgcccaccccccccggcgtcggggctcatccctgtcccggctcggccgggaggcggtccttgtccgcgctgtccctcctccgggacgcgggcagggcggcgcgggtcagccgggcgccgaggctctccaggtactccaccagctgcggcggcccctgcgcggagaactcgcagtccaccaacgccagccgcagcgccacccactccagcgaatcggtgcacgaggtccgcagccggcagccgccctccccgtccggctcgggagccccgagatgcgcgggcagccgcgccgccacgaactccgccggcgccccgaaccacacatcgaggcacaactccggcttcatccgcctcatcgaccgggtcaggaacctcgccgcgtcctcgctcctcgcgtcgctccccgtgccctcggcgggcagtggcctcggcgcgaaccgggaccccgtcgcgtacggctcgccgacccggtccacccggaacgtacgccagtcctcccggccgaggtcgtacgccaccaggtaccagcgctgtccggtgctcaccagccggtacggctcgacctgtcgcttcgtccgggtgccgtcgccgctgcggtacgcgaacctcagccgctcccgcccggtggccgccgaggccagcgtcgtcagggtccgcgggtcgatggtggcgccgtcgccccgggtcagcggcaccgtggcgttctggagcgcggagacccggtgccgcagccgggaaggaagaacctgttccagcttcgccagcgcccgtacggaggcctcgtcgacgccctcgatggcgtgcccggccccggcccgcagccccaccgcgatggccaccgcctcctcgtcgtccagcaggaggggaggcatggcggcgcccgccaccaggcgatagccgccgacggagccgcgtgaggcctcgaccgggtagcccaggtcgcgcagccggtcgacgtcgcggcggatcgtgcgcggactgacatcgagccgctcggccagctcgccgcccggccactcgcgcggggtctggaggagcgacagcagtttcagcagtcgtgcgggagtgtcggacatggcttcaggatgccggaccaacaggtcatgttctgacctaatggctgcataggttctccccatgccttcctccgcacccccgcctcccacggcgtcgcacttcgcaccgtccacaccgcccgcagcacccgccacgtccgcggcacccgcgacatccctcctggggaagacgtcggccgtgcccccgtcggcatcggtgggcgcgccgggcgcggccggggccgccccggccgaccggcggcgctggttcgcgctcgccatcgtgatgaccgccgccttcatggacctggtcgacgtcacgatcgtcaacatcgcgatccccagcatccagcgcgagaccggagcctcggtctccgcgatccagtggatcaccgccggttacgccctcgcgttcgcagccgggctgatcacgggcggccggctcggcgacatctacggacgcaagcggctcttcctcatcggtatcggcggattcacgctcgcctccgccctgtgcggcttcgcgggcagccccgacatactggtcgcggcgcgcgtcctccagggcgccacggccgcgctgatggtgccgcaggtgttgtcgatcgtgcacgccaccttccccgcgcacgagcgcggcaaggtcttcgggctcttcggcgcgatcgtcggactcggcgcggtctccggtccgctgctgggcgcgctgctcaccgagtgggacctcttcgggctcggctggcggccgatctttctgatcaacctgcccgtcggcatcgccgggctgcttctcggcgcgaagttcatcaccgagtcgaaggcccccagggcggtccgtctcgacctgctcggcgtcgccctgatcactctggcgatgctgatgctcatctacccgctcacccggggacacgagctgggctggccgctctggggtcatctgtcgatggtgggcagcctgttcgtcttcggggcactggtcctgtaccagcgtcagaaggcgctgacggacggctcgccgctgatcgaactgtccctgttccgggtcaagagcttcgccgccggcatcgccgttcagctgaccttcggcgttggtctcggcatcttcttcctggtctggaccctgtacatgcagatgggtctcggctggagcgtgctgcgcgccggcacgacgggcatcccgttctccgtcgccgtctcggtggccgccgggatctccgtgcagaagctggtgccccgcttcggccgcaaggtcctccaggccggtgcgctcctcatgatcgccggactgctgatctacctctgggagagcgagcggtacggcatgggcatcacgtcctggcagatggccgtcccgctggtggtcatgggtgtggggatggggctgatcgtggctccgctgaccgacgcggtgctctccgacgtacccaaggaacacgccggttcggcgtccggcctgatcaacaccgtgcagcagatggggacggcgctcggtctcggcctggtgtccgtcgtcttcttcggagcgatcggcgaccggctggcccccgaggaggtcggcccggcgttcgtcgccgcgttccagcagtcgctgtggtgggtggccggggtgctctcggtgatcttcctggtgatgttcgcgctgcccgcccggcc

SEQ ID NO: 4119 - DNA, 608 bp, Unknown
  Kingdom: Bacteria, Phylum: Actinobacteria, Class: Actinobacteria, Order: Streptomycetales, Family: Streptomycetaceae, Genus: Streptomyces
cggatcaccggggtgggcggcccgcgcggtcgcgcgaccggtccatgcccacaggtgcagggtgaccgcgaccgcgaacgtgctcggcgcgctccagcgtgccgggtccgcccagtggatcagggccaggggcaccagtacgaggaccggaacccagcggctcggggtcagcagccgggtgagccggccgatcccggtgagcaggagcagcaggttcaccgacgcggccaccgcgacgacggacgggcccgagagcccggtggcgcgggcggccagcccctggagcagcgcgtacggggagtagtgcgcgctcgccacggcgggcaggtcggtcatcgggaacgccgggtgcagcaggttcacccgcagccgttcgacgaccgccgcctggagcccggcctcgcagcacagcggagcctgccaggccgccgccgacagcaccgcccacagcaggccgcccagcacgaggtacggcgacggcagccacaggggtggccgggccgtcccgtcgaacccgtcgcctccggtcgcggcgggcgggagatcggagggcggggcggaggcagcggagaagaggggcacatctcatgggttccgtgcggcgggcc

SEQ ID NO: 4120 - DNA, 3704 bp, Unknown
  Kingdom: Bacteria, Phylum: Actinobacteria, Class: Actinobacteria, Order: Streptomycetales, Family: Streptomycetaceae, Genus: Streptomyces
acgcacggcgcgccgtgcgtcatgaccgcccgcgcgccgtgcgtcatgaccgccccccgcggcgcatgctgacggatcggcgcattccggcgggcgaatctggccagaacccgacgctgtctcatcaggcggtcatcacaccccttcccgcccgcgacgccgcggtgcgcttcacgcacgaaacctgtgaccaccctgtgaataccgggctccacaacacccggtaacactgcggcaatgatcggtgaaacgtccgcttaacgaacatgacctttccggcaacgaacgaaaaccggccaacttgttgacgcggtcctgacaggtgcggtcatctgctgacactcttcaccccgttctgcgcaccgcctgcaccgtccggacggcccgtccagcgccgccggtacccccctcgcagaaggagtccgcgtgagatccacgcccagccgtcgcgccaccgcgaccggcgctctgatagccgcagcagccctcgtagccgtcgccattccgtccggcgccgcgaccgccacctccgcaccctcctcggccccgctcggcggcatcaccgccggcacgaaggccgacccgggcgccctgcccgccaagctctcccccgcccagcgcgccgagctgctcagcgaggcgaacgccaccaaggcggccaccgccaaggaactcggcctcgggtccacggagaagctcgtggtccgtgacgtcgcccaggaccgcgacggcacgacgcacacccgctacgagcgcaccctgggcgggctccccgtcctcggcggcgacctcgtggtcaaggcgtccgcggccggagcgaccgagggcgtcagcaaggcgtcgaaggcgaccagcgcgcagctgaaggccgtcggcctcaccgccgacgtggccccggcggcggccgagaagcaggcgctcggcgctgcgaaggccgagggctcgaaggcggagaaggccagcgaggctccgcgcaaggtggtgtggctgggcagcggctccccgcagctcgcgtacgagaccgtggtcggcggactccagcacgacggcaccccgaacgagctgcacgtgctcaccgacgccgcctccggcgagaagctctacgagtggcaggccgtccacaacggcacgggcaacacgcagtacaacggccaggtcaccctgggcaccgcgccctcgtacaccctgaccgacaccacgcgcggcaaccacaagacgtacaacctgaaccgcggcagctccggcaccggcacactgttctccggcccggacgacgtctggggcgacggcactccgcagaacgccgagacggccggcgcggacgcccactacggcgcggccgagacgtgggactactacaagaacgtgcacggccgctccggcatccgcggtgacggcgtcggcgcgtactcccgcgtccactacggcaacaactacgtcaacgcgttctggcaggacagctgcttctgcatgacgtacggcgacggcagcggcaacgtcaagccgctgacctccctggacgtggccgcccacgagatgacgcacggcctgacctcggtcacggccaagctggtctacagcggcgagtccggcggcctcaacgaggccacctccgacatcttcgccgcgggtgtggagttctactccaacaccgcccaggacccgggcgactacatggtcggcgagaagatcgacatcaacggcgacggcaccccgctgcgctacatggacaagccctccaaggacggcgcgtccaaggacgcctggtactcgggcatcggcaacgtcgacgtccactactcctcgggtccggcgaaccactggttctacctgctctccgagggcagcggcgccaagaccgtcaacggcgtcaactacgactcgccgacctccgacgggctcccggtgaccggcatcggccgggacaaggcgctgcagatctggttcaaggcgctcaccaccaagttcacctcgacgaccaactacgccgccgcccgcaccggcacgctcgcggtcgccagtgagctgtacggggccaccagccccgagtacgcggccgtggcccacgcctgggccggcgtcaacgtgggtgcccgccccggcggcggcaaccccgacccgggcggcaaggtgttcgagaacaccaccgcggtgaccatcccggacgccggtgcggccgtcaccagctcggtcaccgtctccggtgtgaccggcaacgcgccgagcaccctcaaggcggacgtgaacatcacgcacacctggcgcggtgacctggtcgtcgacctggtggccccggacgggaccgcctaccggctgaagaactcctcctccggcgactccgcggacaacgtggtggagacctacacggtcaacgcctcctccgaggtggccaacggggtctggaagctgaaggtccaggacgtcgcacgccaggacaccggacggatcaacagcttcaagctcaccttctgatcccaccgggcccaccggcccggagggagcacacacggaacggcccgggaggggttcacccctcccgggccgttcgcggggacccggcacgggtgccgggtccctcgggtccgccgcggcgcgcgctcagcgcagcagcacgcccgcaccctcccccgtcgcctcggtcggcagcgcgaccaggcccagttcggcgctggtggccagcagcgggtgggagggcaggacgcgcacggtgtagccgtacggtcccgtccggtccagcgcgagcggtccctcgtacagccagcggttctccaggtcctggccgcccgccggtttcagcggaaggacctgggcgtccgcgatggcgtcacccgcgtcgacccggcccgcgaccacctggacctccacatcgtccgggtccaggccgccgagcgcgatccgcacccgcagcgccagggtggcgccgagctccgccgagccgcccgccgcggtgtcggtcaccgactccacatggtccacggagaccccgcgccaggccgcccggaccttggccttccactgggcgagatcccgcgcggccccggagtccagggcccgccgggactgcgcggcgggggcgtacagccgctccacgtactcacgcaccatccggcccgcgagcacccgcggtcccaggttgaccagggtggagcggaccatctcgatccagcggtcgggcagacccccggtcccccggtcgtagaagcgcggcgcgacgcggtcctcgatcagggcgtacagggcgttcgactccagctcgtcgcggcggtcctcgtcgatcgccgaaccgtcggcggtgggaatctcccagccgaagtccgggtcgaaccactcgtcccaccagccgtcgcgcacggacaggttgaggcagccgttcagcgccgccttcatcccgctcgtgccgcacgcctccagcggacgcagcgggttgttgagccagacgtcgcagcccgggtagagcttctgcgccatgcccatcccgtagtccgggaggaagacgatgcggtggcggacccccgcgtcgtccgcgaaccgcaccaactcctgcaccagccgcttgccgccgtcgtcggcggggtgggccttgcccgcgacgacgatctggatcgggcgggtcgggtgcagcagcagcgcccgcagccggtcgcggtcgcgcagcatcagcgtgagccgcttgtacgaggggacgcgccgggcgaagccgatcg

SEQ ID NO: 4121 - DNA, 781 bp, Unknown
  Kingdom: Bacteria, Phylum: Actinobacteria, Class: Actinobacteria, Order: Streptomycetales, Family: Streptomycetaceae, Genus: Streptomyces
cgatcgtcgcggcgaccgcggtcgtcgtggccgccgccgtcacgggcgtggtcgtcctcggcaaggacgacgacggcaagaccgtcgccgacgacaagaagtccgcgtcgccgagtgccaagcccagcgcgaaggacaccggctccgcgccgccggcggagaacccgcgaggctccgacagcgaccccaagccggtcgtaccgggctggaaggtcgtcaccaaccccaagtggggcacgcagttcgacgttcccggtgactgggaagtcgcgggctcgggaatgttctccggcttcgaggacgccaagaagcccgacggcccgcccgtcgcgggcttctccgcacccgcctactacaagagcaagtggtgcgtcgacgactccgacggggacggcagccaggaggacaccgggctcgccggcgtcgggacgaagggtgcccagggcgccaagaacaccgacgaggccgcgaccaacgaggccgccaactgggtgtgggccgcctacgcccagctggaccccaagaccaaggtcaagatcggcaagcccaagccgttcaccaccgagtcgggcctctccggcagcgtcgtccaggccaccgcactggagctggccaacaaggagaagtgcgacagcgacgggaagtcgatcgccttctcgttcaagaactccaagggtgatttctcgacctgggtcctctacgccgccgccggcgtcaaggacgagcttccggacaccaccatccagaagatcctgagcacggtccgcctctccggtcagcc

SEQ ID NO: 4122 - DNA, 564 bp, Unknown
  Kingdom: Bacteria, Phylum: Actinobacteria, Class: Actinobacteria, Order: Streptomycetales, Family: Streptomycetaceae, Genus: Streptomyces
  misc_feature (216)..(253): n is a, c, g, or t
gaacccgcgcgggccgttccggcccgtcctggccggtggcggcgggctgctccgaggcgtcccggccgggcccctcctgctccgggccgtcctgctcagcgtcgtcgtcgatgtcgacgccgtagtcggtggccagcccggcgagacccgatgcgtacccctggccgacggcacggaacttccactcccccgagcgccggtacagctcgccgaagnnnnnnnnnnnnnnnnnnnnnnnnnnnnnnnnnnnnnnggcgtcgagatcgaaactgatccggtcctcgctgccgtcggccgtgggcgtcttgccgagcagttgcacacttccgttgccggccacgggattgttgtagaagcagaagtcgatgtcgctgcggaccttgccgtcaccgtcgagcagaagtacggagacgtcggcgtcgccttcgcccgtagtgctgctccaccccaggctcaccatcaccgagccgacgtcctcgctcagcgtcgtcagaccgacattggcgcccttgaccatctcgtgcacgaggccccccagatgcacagccgtccggaacgcacccc

SEQ ID NO: 4123 - DNA, 1810 bp, Unknown
  Kingdom: Bacteria, Phylum: Actinobacteria, Class: Actinobacteria, Order: Streptomycetales, Family: Streptomycetaceae, Genus: Streptomyces
tcgtcgcggtcaccggctggctcggctggtccgccgccggatacgccgtgctctcccgcggcttccgctcgccccgcgccttcgtcgaggcccaccgccgacccgaaccgccgtaccacgcgggccccgcggccgccgggctcggcgccaccgcgatgaccgacgtcagcgacggcctcgtcgcggacctcggacacatcgcggagtccagcaaggtccgcatcgacctgcgctccggcctcatcgacatcccctcgcagatgtccgacatcggccaggccgtcggcgtcgacccgctccagtgggtgctgaccggaggagaggaccacgcgatcgtggcgaccttcccgccggacgtgaagctgcccgcccgctggaaggtgatcggcgaggtcctcaacccctccgccctgccccaggtcaccgtcgacggcgccccctggaccagcaagggcggctgggaccacttcggctccatcgaggacacccagccgcgcacgtgagcgggggacgcacgcgcgagcactagattgctgcgtatgcccatacgtaccgctgccccgccccgtgtgctcaccgtcgccggatccgactccggcggcggtgcggggatccaggccgatctgaagacgatgctcgcgctcggggtgcacgggatgagcgtgctcaccgccgtcaccgcacagaactccctcggcgtccagggcgcgtgggagcttccggtggacgccgtgcgcgcccagtaccgcagcgtcgtcgacgacatcggcgtccaggccgtgaagaccggaatgctcgcctccgccgctctcgtggagacggtcgccgaactcctcgccgcaaccgacgcccccgtcgtggtcgacccggtcggcgtctccaagcacggcgacgcgctgctcgccgccgaagccctcgattccgtacggacgaagctgctgcccgtcgccaccgtcgccaccccgaacctcgacgaagtggcccagctcaccggggtcacggtcaccgacgagagcggaatgcgccgggccgccgaggagatcctcgccttcggaccgcgctgggtcgtgatcaaggggggccacctgcccggcgaggcggtggacctgctcaccgacgggagcgcggagcactggctgcgcgccccccggcacgacaaccgccacacccacggcaccggctgcacccttgcctccgccatcgcctccgggctcgcgctggggagggacgtgcccacggcggtacgggaggcgaaggcgtacgtcaccggcgcgatcgaggccggcttcccgctcggcggcgggatcggccccgtcgaccacggctggcagacccgccaggccgccgatccggcttcctgatccgcccctgagcacagcaaaaagccggtccaccgagatggaccggctttttgggcaaccggaaggctgcgctacgacggggacgtcagcgcgcgaccttgccggccttgatgcacgaggtgcagacgttgagccgcttcggcgtccgaccgaccacggcacgcacgcgctggatgttgggattccagcgacgggacgtacggcggtgcgagtgcgaaatgctgttgccgaagctcggccccttgccgcaaacgtcgcagttggcagccacgggtcactccaaagacttcagatgcacttacagtgaaatccggcgcgccggaatcatttgactgaagtggcggtaccggagggatggcccgactctcatcgggcaaccggagcagcatacaacgcctgcttcggagatacgaaactaccacgggttggcccatcgccccgcccgcccc

SEQ ID NO: 4124 - DNA, 747 bp, Unknown
  Kingdom: Bacteria, Phylum: Actinobacteria, Class: Actinobacteria, Order: Streptomycetales, Family: Streptomycetaceae, Genus: Streptomyces
cggccgccgttagactggcccacatgggttcgtaccgcttctacttcttccgctgattcccggcccggacggccgcagcgcgccgcaccgcgcgtccctctgagacgccccggtgacgtcgacgtcgccgcacgcgcccgccgccgtccccttcgccgtccggcatccacgccccgccgccgcgcctccacgcgcgccttcgcgggccgtcacccagggaaaaggcacccatgcacccccagcgcgaccgcgctcaactggccatgaaggacgtctccaaggcgtacggggaccgctccgtactcgaccaggtgaccctcaccgtccggcccggtgagaagaccgccgtcatcggcgagaacggctccggaaagtccacgttgctccggctgctggccggagtggaacaaccggacaccggtgagatcaccgtccgcttccccggcggcgccggctacctcgcccagaccctcgacctcgacccggacgacaccgtgcaggacgccgtcgacgcggccctcgccgacctgcgcgacctcgaacaccgtatccgcgaggcggaggcaggcctctcggagcggaagccgggcgacccggggccggccgacgaggagctcgccgcgtacggagacctcctcaccgcctacgaggaccgcgacggctaccgggcggacgcccgcaccgaagcggctctgcacggcctcggcctcgcccacctcacccgcgaccgtgctctcgccacgctct

SEQ ID NO: 4125 - DNA, 1384 bp, Unknown
  Kingdom: Bacteria, Phylum: Actinobacteria, Class: Actinobacteria, Order: Streptomycetales, Family: Streptomycetaceae, Genus: Streptomyces
cgcccgccctccccgaagaggccacggaggaggacatgcgggccgccgcccttcagtacgtacgcaaggtctccgggttccgcgcgcccgccgcgcacaaccgggaggtcttcgaccgggccgtcgacgagatcaccacagccacgatgaagctgctcgacggcctggagatacggggcgcggcccggagctgaggctcgccgcccgcgcgtcagcccctccggtgcgctcttccgatcagggggcggccggtgcgggtgccgacaccggacccgacccgccgagggtggccgacccgccgccggaagcggcgccggaggtaggcaccggcacggacacgagcgggggcgtcttcggcgccatcgccaccaccgcggatgccgatccggacgcggttgcgtatccggacccgggcatggatccggctccggataccagtgcgtccgtcagcggcgtctccgctgcctcagccgtggcttcggacgtcgtcgccgtccgcgtcgccgggcgcttcaccacgaacgcggccagcgcgcccgccacgaacagggccagcacggagacggccgtgccgaaccacgtcgagcccagccaccggccgccgaagtagccgagacctacgctgtaacccgcccaggccaggcccgccagcgcggaccagggaaggaagtcccgcttcctgcggtgggcggcacccgcgccgagggagaccacggaacggcccgcgggcgcgaaccgggcgatgatcaccagcgcgccgccaccccggctcagagcagcgccgagacgttcctgcgcggaggtgaggcgccgggagcgcgcgatggcccggtccagccggtcacccccgcgccaggccagccggtacgcgacgaggtcgccgagcaccgaggcggaggccgcgcacaggatcagcacgacgagcgagggaacctgcccgccggtgcctgcaccggcgccgctgacggtggtggtgcccgctgccgccgccgtggcggccgtgatgacgagcacaccgctgggcagcaggggcagaaagacgtccaggagaacggagagggcgaccaccgcgtagatccatgggctgctggtcagcgcgcccacactctctagcaccgtctactactccccgatcgtgtcaacgccgcgacgtcgcaggggagcggcatgggcggcaggttcagctgtacagcgtacgcgtgagggtcatccggacatcgcccggggcgggtgatgttgtgcaggtcacgtacacctggaggccttgtgcccgttaggcggggagaacgaccggcacgagcgaggagcagcgcatgacggcatggatggtacggacggaacgcggtacggcgcacccgaattcggggcggcgggcgacggcggg

SEQ ID NO: 4126 - DNA, 6035 bp, Unknown
  Kingdom: Bacteria, Phylum: Actinobacteria, Class: Actinobacteria, Order: Streptomycetales, Family: Streptomycetaceae, Genus: Streptomyces
acgtcttcaccggaggccgggagcgtcggagacggtcagccggcctccggtgaagacgtggcgctcagtgatgacgtcctcggtctgccaggggtagtggctgtcgcaggcgtacgcgaggtccggcacggtggcggcgacctgggtcatcgcggcgaggctgatgccgaggtgggtgttggagtgcatggagagtccgacaccgaatgtgcggcagatccccgccagttcccgggtccggtgcagtccaccccagtagtggtggtcgctcaggacgatctggacggcgtcgcgggagaaggcctcggggacctcggcgagggtggtgacgcacatgttggtggcgagcgggacgtcggtcccggccgagacggcggccatgccctccgtgccgctggtggggtcctccaggtattcgaggacgcccttcaactgctcggcgacgtacagcgaggtgggcacggaccaggcgccgttcgggtccaggcgcagcgggtggcccgggaactcctcggccagggcgcggatcgcggcgatctcctggtcgggctcgaagacgccgcccttgagcttgaacgaaccgaagccgtaggtgtcggcgaagcgccgggcctgggcgacgacgcctgccgggtcgagcgcggccccccagtcgtcggcctctcccgctccggggtgggcggcccagcggtagaagaggtacgcgctgtattcgacggtgtcgcggaccttgccgccgagcagggcgtgcaccggcaggccctgcgccttgccgagggcgtccaggcaggccacctcgaaggcggagacgaccgagagccggatcttcccggtgttcctgaccccgcggagtcccccggcgtcgacccggtcgtcggtcgcgtgcgcgtcgccgcacacctcctcggcgagggcgaacaacccgttcagatccgtgaccgtccggccagggagcgcctcggcgagggaacgcgcgggttccaggtaggcgccgtcgccgtacgtctcccccacgccgaccgttccgcctcgggtgacgacctccacgatcaggcgtggggtgtacggctggtggacgccctgcgtgttcagcaggggcggatcggccacgaggatcggggtgagccggacgtcttcgatcaccagatctgtattcatacgtgaactctattcagggatgcgttttaccgccaggcccttaccccgagggactgactggctgcccggcctctccgcccagccgccggacccgaaggcgcggcggccggaccgaccgacttccggatgccgcgccacaggggccggacgcggtgccttccggttgtggtccggggaggcaccgcgtcaggagcatgagcggtcagctgtccgccgagccgccgcggaccacgcaggagcggttgttctcccagccccagccgtcgccgtcggggtcggaggagccggaggcacagtaggggtaaccgttcggggcggtgccgccaccactgccggtgtccgccgggccgccgcggaccacgcaggaccggttgttctcccagccccagccgtcgccgtcggggtcggaggagccggaggcacagtaggggtaaccgttcggggcggtgccgccgtcctccccgccggggacgtcaccgtagaccgtagcgggcctggatgtggccgagatgccgttggcgccggtgaggaaacggctgccccagctcgtgggtgcgtccgcgtcgaaaccgttgaccatgtcgaggtactcgactccgctgccgtttccgctccaggaccagccgatgtagccgaccttcagggactgggcggtcgccatgatggcgtcctcgtccgggttgccgtcgctgtgtgcgtcgccgaactcgcctacgacgatgggcagtttgttgctgacgaagtggttgaggtagtcctgcacctcggccgcggtgtcgtacacgccgtacatgtggatcgagaagatcgtgttgcggtcggggtcggaggcgaagaccgaggcagcgttggtccgcatggtgttggaccagtcctggccccagttgggtccgtcgaccatcagcgcgtggtggaggccggcgccgcggatcttgccgatcgcgttcttggtggcatcggtccaggcggtgtagccggtgttgccgaagggctcgttgccgatgttgacgacgacgtagttctcctgcccctccagggcactcttgacggcgatccagtagtcggcggcccggtccagcgacgcggcggcgccgtcctccccgtatccggtcgtgtcgtgcacctccagcacgcagatcagcttgttcgccttgcactggccgatcagggaggaaacctcggaggcgctcgtcctggtccagcggtcaccgctgccgaggacgatgcgcaccgtattggctccggtggctgcgatgtcggcgagcgagccggtctcacccggataccagacgtgggcgtggttgacgccacgcatcacgaactcgttcccgttggcctcgtacacgcggccgtcggcgacccggagccccgtcgcggcttgcgcgccggtggccgtcccgaagacggccagcgcagcgccgaccaggccggccacggccatggcgacgaccgtgtacagagtgtttctctgcggcggtttcatttctctcctcaagtggggggctgcagcagccctggcgggtccgggaggatcagctggctcccgggtacgacttcttgagcggctcggccgacggctgcgcatgccgcgcggctccggaggtggtcccgacgatcggccggtatgccgacctctgcggacaacgttgtcgccgctctggacggagggtggagatcggatcacgcgagcggcattcacccggaagcgatacgccggtaccggttggcgcccgcggcagaagtgaccccaggacgcgccgagttgcggcggggcctcggtttccggccgcaggccggatgtcgcacccatatgaggcaccgaatgttccggtcatgtcaatagacgtgtcacggcgatttcggcctccgttccgcgcgagtcgacttcgccgcatgtccacctccgtcgactgcgtcgaaattcttccggtcgccttcggttcgaccggccaaagcgggaggccggcggtattgaccggcccttgagctcgtcgtgttatcgcctttggtagcaaggaaagcgtccacgccgttccgtcgcacccccgtgagaactttgcgaaatacttactcaactaaaccagttcactagacaacgttgtcagcaccgggcacagtgtcgatcccgaatgatcgggcactcccctcaggaaagggcagaacgtgacggtgtacggagcactcgacatcggcggcaccaagatcgcaggggcgctcctcgacggagaaggccgtcttctcgcgcgggcgcagcgcgcgaccccggccacgagacccgctgccgacctggcggccgccgtgatgaaggtgctggacgaactggcggccttcccatcctgggacgagatgtcctgcatgggcatcgccagcgcaggcccggtcgataccgtcgcgggcacggtcagcccggtcaacattcccggctggcgcgggttccccctcaccgatctcgtgcgcacccaccctcgtctgcccctgggggtcctccccgttctggtcggggacgccgtcgccatgacagcggccgaacactggctcggcgccgcgcgcgggttcgacaacgccctctgcatggtggtctcgaccggggtcgggggcgggttaatcctcggcgggaaggtgcacgcgggtcgcaccggtaatgccggacacatcggccacatcacggtcgatcacgagggtccgcgctgcgtctgcggggcaccgggatgcgtcgagagtctggcgagcggaacggcgatcgccgcccatgcgcgggctctcgggtggacagcggagcccggcgtgtcctcgaacgccgcagcggtcgccgcagcggcccgcgacggggacgagcgagcgctccgcgcctaccggagatcggcgcgagcactggccgcggcgatcgctgcgacggcggccctcgtggagctggagcgggtggtcgtcggaggcggtgtcgcgcaggccggcgacgtcctgttcgcgccgctgcggcggtacctgaacgactacgcggtgctcgacttcgcccgtgggatctccgtcgtccccgccggtctcgccctggacgccggactcatcggagcggccgccacggcatccgcccaggcctcgtatccggcggggatcccgcacttctgacaccgccgtgcgccgccctcggcggcagccggaagggaaaccccgtggatcaacttctgaacaccattcgtccctacccctggggctccaccaccgcgctggccgacctgatgggaaccgtttccgacggcacgccccaagccgagctgtggatgggagcccatccggcggcgccctcgcggctgttccgcgcctccggccccgagacgctcgacgcgctcatcgcctcacggccggccgccgagctcggagaagcgacgctgcgcaggttcgggcctcgtctgcccttccttctcaagctgctggctgtccaggcaccgctctccctccaggtgcacccggatctggcccaggccgccgtcggacaccggatcgaaaacgcgcaaggcgtccccctcgacggtcctcaccgcaattaccgggacgacaaccacaagccggaaatgatcgtggcgctcagcagcttcgagggcctctgcggcttccggccggctgcgcactgcgctgacctgctcgaagcgcttggccttcctgaactcgccccgcacgtcacagcgctgcggaaggagcccgaagagcccgccctccgcgccgtgttctccgccttcctcgccgcccccgagtcgctggtcgacgcggtggccgggtcggtggcccgccaggcggagcgcgcagggggagaccggtccgcctggaaggcgtacgacgggatcgcccgggcctgtccgggcgatcccgggctgctcgccgctctgctgctgcggcacgtgcgactggacccgggcgaaggcatcttcctggcagccggagtcccgcacgcctacctcggcgggctcggcgtggaaatcatggcctcgtccgacaacgtcctcagatgcggcctcacctccaagcacgtggacgcagaggagctgctacgcgtggtgaggttcaccgcctcgcccgtacgcgtcctgcggcccgcggcgcacggagaggaagccgaagaggtctatccggcaccggtcgacgacttccggctttcccgcacccgcctctccaccggatcctgcgcccgcctggatgcgacagcaccccagatcctgctctgcacgcgcgggcgcatccgcctgagcagctcatgcggctcgctgaccttggggccgggggagtccgcttacacgccggcaggggagcaggtgacccttcggggagagggcgaagtcttccgagcgactgtcgacgcggggcaggcagccgaagggaaacgcgcatgatgcacctatttgcccaccgggcctccctgaaccggtttggcagcgggaacctattcgggcgagctgtcgatcgaccgccggacatgcattggttctggcccgggtatcggcctctgcgggacgcccgataattccgaaggatcaggtgagggtgagcctggaagcgcctctcggagttctgtgcgttcttccgttgaaagatctctttcatgcgtggcgtgggtcgtgcgcctatctcttatccgggtacttctcacggtctgatcgactgatcaacgccggctccggcttgccgctgagagaatgcggccccaccctctactgaagactctttgcggcacatgcatccggccggtcctgtgaccggccggatgcatgtgccgttgtgggccgagcccacgggacggggctggtcgcggcggagaattcggcatcgccggacgcccggagggggcttcgcgagaacgcgcccgcgctacttggtcgcgccctgggcga

SEQ ID NO: 4127 - DNA, 792 bp, Unknown
  Kingdom: Bacteria, Phylum: Actinobacteria, Class: Actinobacteria, Order: Streptomycetales, Family: Streptomycetaceae, Genus: Streptomyces
aggcccgccgagctcgccggggccctcgacgccctgggggcgggcgccccacggccgctcggctacgcggacgcccgcgtgccggagtcggcccctggccgggcccggttcctcgacgcgccgctggacgaggccgtggaggccgtcgtgggccatatccgtgacgtccggccggagctcgtgatcacggcggacgcctacggaggcatgaccggccacccggaccacgtgcacgcccaccggatcaccacgccggcggtccgggcccccggcgtcccccgtttctgtccaggatccggtgatccctggcagccgagcgtcctctacctcgccacgcacccccgctcggcggccgttccggtgggcgggcggctggcccggcggggaaccccggccgacgcgctgtactgctcggaggacgcgtggatcaccacgaccgtcgacgtcggcccctggtctccgcagaagctgaccgcgatcctcgcgcaccgcagcgaggtggaacgaggagcggtgcccggccggatcgccgctctgcctccggcagttcaccgcgaggtgctgggcaccgagtggtgggccggtagctcctgcgtggggagcggccacgatcccgccgcagccgccaccgctcctcccccagccggtcagaacagctcgggtgggttcctgagctgccgctccgcctcctggacgagctcggccggcgcttctggcccctcgtcggggtgccgctgccttctcggccacggctccgctttctcgttcgtggacctggacgtcactcgtccg

SEQ ID NO: 4128 - DNA, 884 bp, Unknown
  Kingdom: Bacteria, Phylum: Actinobacteria, Class: Actinobacteria, Order: Streptomycetales, Family: Streptomycetaceae, Genus: Streptomyces
cgtggggggcagttcgtgggggactgttcgtgggggcgttatccggcggagcggacggcttcggtgagcgtggcggccggacggaacgccagcgtggcccggcccacggtcatgacgcgctcgccgtcggccagcgcctcaccctcgaagatcatcgtgtcggtgaggacccggaggacccggacgtggtgcacgaccacttcacccgggtacacgggccgttcgaagcagacgtcgctgaccccgccgaagagcatcacccggccgctcagcacgtccgggttgggactctcccaggtggcgagcacccccgccgcctggcaccacgactccgtcagcagcacctccggatagccgtagctctccggcggagcgtcctgcggaatcccctcgtaccagggctcgttggcggtgaccgccttgcgagcgaccaggcgttcgccgggcaccacctcgtcgacccggtccaccagcagcatggggtggcggtgcggcagcagcccgcgcagttcggcggagccgatcatcgaagcctcccggcggcgaagcggagcctgacggtggcggcggtcccgcggaccgtgcgcacggtcgaggcagcacgccactcgtccccgtcgggggtgaggacgagctccacggtcagttcgtcgcccggcaggaccgggccgcggaaccgtgcggactccaccgccgcgagccgggccggcggcagcaggagcagcgcgctgcggcgtacgcattcgatgacgcagacccccgggaagatcgggaaccccgggtaatggccggcgaagaacgcctcgtcggggtcggcccggcacagcgtggccgcgctcagcgaaccgtcgtcggcgcgcaccggcgggtgcgcgatccggacc

SEQ ID NO: 4129 - DNA, 945 bp, Unknown
  Kingdom: Bacteria, Phylum: Actinobacteria, Class: Actinobacteria, Order: Streptomycetales, Family: Streptomycetaceae, Genus: Streptomyces
ccgggggtccgaagccagccgcggccggtccgcctccgcgcccggccggcccggccgcacccccagcgcggccagcaccccggccgccttggcatgcgtctcggcgacctcgctctccgggtccgagtggcgtacgagggtggccccgacgggcaccttcagcgagccgtccggggcgatgtccgccgtacggatcaggatcggcgagtccagggtctgcaccccgttcgcgtcccggcccagcagggccagcgcgcccgcgtagtagccgcggcccccggtctcgtaccgctcgatgacccggcacgcgttctgcaccggggagcccgtcacggtcgccgcgaacatcgtctcgcgcagcacctcgcgcacatccagcgaggaccggccgcgcagctcgtactcggtgtgcgcgaggtgcgccatctccttgagccggggtccgaccaccaccccgcccatgtcgcccaccgtgcacatcatcttcagctcctcgtcgaccaccatggacagctcctcgctctccttgcggtccccgaggaacgccagcaggctcgtcgcggtgggcccctcggccgggtagcggtacgtcccgctgatcgggttcatcacgaccgtcccgccggacatccggacgtgcacctccgggctcgcccccaccagcgtccgcccacccgtcgcccgccgccgccccgaggcggagatccctccgggcttgctgcctcctgtgtggacgacgaacgtccagtacgcgccccgctcgcccgccagcagccgccggaacagcgccagcgcgtccgcccgcccgaacccggggattgcgccacggaacgtccgccggatcacgaagttcgcgccctcgccctgcccgatctcgtcgcggatcacccgccgcacgatgtccgcgtactccccgtccggcacgtcgaagccgcggtcctccac

SEQ ID NO: 4130 - DNA, 2556 bp, Unknown
  Kingdom: Bacteria, Phylum: Actinobacteria, Class: Actinobacteria, Order: Streptomycetales, Family: Streptomycetaceae, Genus: Streptomyces
ggcggcgacacggggggaacgcggggagatcagttcgggggtgcccatggtcggcggcgagcctctctgcgtacggctgtgacggtgtggggtgtcgtcggcggggtgggccggcgggtcaacgcaccggacccgcaggcggcgtgcgcctgcgggtccggttcgcgtacctggaaggggttgcctggatcaggcggccttcggagcgttgacgtcgctcgggagggccttctgagcgacctcgacgagggcggcgaacgcgttggcgtcgttgaccgcgagctcggccaggatcttgcggtccacctcgatgttggcggccttcagaccctggatgaggcggttgtacgtcatgccgttctggcgggcagcggcgttgatgcgctggatccacagctgacggaagtcgcccttgcgcttcttgcggtcgttgtagttgtagaccagggagtgggtgacctgctccttggccttgcggtacagacgcgaacgctgaccgcggtagcccttggccgcctcgagaattgcccggcgcttcttgtgggcgttgactgcccgcttgacgcgtgccacttgttaactccttgtagcggggccgtgggtgtcttcacacggcccggaaacgaattggtcccggtgtgatcgaggtcgtgcctccggggcgagccggaggccgagcctcacttgccgagaagcttcttgatcttcttggcgtcggccggagccacgacgaccgtgccggtcagcgagcgggtcttcttggacgacttgtgctcgagcaggtggcgcttgccggccctctcgcggagcaccttgccggagccggtgatcttgaagcgcttgctggcaccgctgtgcgtcttgttcttcggcatcgcgccgttctctcctcgtcagtggcgcccctcacggtgcggggcaccggactgcaggggcgtcagatctctatgggattccggggggacccggggccgcctggatggcagcccctgaggtcacgcctcggaaggtgtctcggccggagcctcgaccgcttcggccggagcctcggcggtgtcaccctcggacggagcgtcggtcgtgccctgacgctcggccttgcgggcggcctgggcctcacgggcctcggccatggcttcggtcttcttcttgtgcgggcccagaaccatgatcatgttccggccgtcctgcttcgggttggactcgatgaagcccaggtcctccacgtccgaagcgagacgctggagcagtcggaagcccagctcggggcgggactgctcacgaccacggaacatgatcgtgatcttgaccttgtcgccctgcttgaggaaccggacgacgtgacccttcttggtgtcatagtcgtgcgggtcgatcttcggccggagcttcatctccttgatgaccgtgtgcgcctggttcttgcgcgcttcacgggccttcatggccgactcgtacttgaacttcccgtagtccatgagcttgcacacgggcggacgggctgtcgccgccacctcgaccaggtcgaggtcatactcctgtgcgagttccagggctttggcaagcggaacaatcccgacctgctcgccactgggaccgacaagtcggacctcgggaacgcgaatccggtcgttgatgcggggctcggcgctgatggatcctcctcggtagcaccacgcgaccgcctggcggacagccgcgtaacgtcttataacgtcaagaccaaccgagccggaagcacaaaaatgccccggacgggacacaggcggggctccaggaactaccggaacaccgccgcggtcaaccgcggggcgcatcggacggctccatcgtccgtacggaacgatggggaccgtctgaccggtgacccgccgtccggtgaggacggtcaggtgggagatcggagcctccacttgtgggccgggcacatagatgtccggccggtcgttacacaaggttagcagcccggccccgggtgcgctaatcccgcgtctcccccggtatcgcccctctgtccgcccccggcggtcccgaacggctcccgcgcgcgggagggcggtggcctggccttatcgtgtgggcatgagtgacgcgacccccagcagtgagaaccccggcttcgacgacatggcccgcgacatcgcggaggtccccgcggtcgaggtgatcgtgacggtcgccgtcaacctgatgagcgcagccgccgtgaagctcggcctcaccgaggagggcgaggagcacaaggacctcgacgaggcccgcaagctggtccaggcgctggccggactgctggacgcgagcgccacggagatcagcaccttccacgcctcgccgctgcgcgacggcctgaagtccctccagctcgccttccgcgaggcctcgctggtgcccgacgagccgggccacggccccggcgagaagtacaccggcccggtctacggctagccgcccctcccccgtacaccaggaagcccgccgtccccccgtggggcggcgggcttccgcgtgcggtcggccggagcggttcctcagacggcgtcctcggtctcctcgggc

SEQ ID NO: 4131 - DNA, 951 bp, Unknown
  Kingdom: Bacteria, Phylum: Actinobacteria, Class: Actinobacteria, Order: Streptomycetales, Family: Streptomycetaceae, Genus: Streptomyces
cgccgcccgcccgccggaccgtagagcccgccgcgggcgcggtgcgcggccgtcggaggcgggtctcagcggtggcacgcccggggacctgtcggtggggcgtggcacgatggcgcgaaagccgacggagcgggacccggagcgatgagacaccccctccgggaacagaaggacgcacatgaaacagagcggggcggcgggcggcacggccctcgggccactcgcgcacggggccgcagggagcccggtgcccacgggcggcgcggtccgtgagctgctcgcacgggcggagcggctcctggagagcgcccgagccgtgccggcggaccgggcgaacgccgtggacgccgtacgctccgtgctcgatccgctgctcgactccctggtgggccgggagctggccgccatccccgtctcccggctcaaggacgtcaccgaggggcggctgcgtctcggggcgctggagcaggccgggttcggcacggtcggtcaggtccacggcacgcaccgctacgagctccggcagctccccggcgtcggtgcgcacaccgccgaccaggcgctggccgccgccgcgcagatcgcccacgccgtgcgggacaccgtctcggtgcggatcgacgtggacgccccggacgacaccagcaccgcgctggtcgtcgccctgcaccggctggccgtggcgggtgcggacgcgcggcgggccgtggacgcggcccgccggctcaccgagcggctcggccccccggtggcggcggccggaccggccgggagccggctgcggatgctgttcaccgggcgggagacacgcgcgcgggtgcgcgaggccgtcgactcggtgcgagcggccgtggcggacgccctggagcgggaactgccggtgctcttcgcacaggcctcggccgacctgctgcggtcaccggcgtcccccgccgaggcgtgggtggactt

SEQ ID NO: 4132 - DNA, 2142 bp, Unknown
  Kingdom: Bacteria, Phylum: Actinobacteria, Class: Actinobacteria, Order: Streptomycetales, Family: Streptomycetaceae, Genus: Streptomyces
gcacgtcgtaaccgcgtccctcggcggccgcgcgctccagggcgcgcagcgcggccgggccgctgccggccgcggacacgtccacgtccggttcggccgcgagggccgccgcgagcgactcggcgaagatgcggtggtcgtcgaccaccagaacccggatacgcgccacagaacccccatcggtgggggcggacagctgcgggtacggcgcccggaggcctcggagcggcccgctgtgctccggccgccgccttcgcactgcctgccgcccgcccccgggcgccgtacccggctctctcgctcccctgaatcggcaccggcccccaccggtgctgagcatcagcgtacgggtgggggccacagggggaaggcgattcgccgaactggttgcccccggtgtttagggtgtgcttcatgttccgtcttgagacagaagtagacaaagaacgtcgtattctgctgagcgggcgtctgcacgaggacaacatcgcggccgcggccggcctgcgtgcactgctctccacccccgcggagcacgaagtcccgctggaggtctgggccttggacgagctcgggaacctggccggcgggctgagcgggcggacctgggcgtactggctgcacgtcgatctgctctgggtcgacgccccgcaccggggctccggcctcggcgcgcgtctgctcgccgaggccgaacggaccgcccggaccgagcgcgcctgcacccgtgcgcggctggagacctgggacttccaggctcccggcttctaccgcaagcaggggtacgaggagatcggccgggtcgcggactacccgccgggcgtcaccgagttcatcctggtcaaggagttgtgagcgcggcgatgtcccgaaggttcaccgcagtcggcgcgccccggccgacgggatggcgtcgaagatccccgggtccgcgtgtccggccgccgcgaaggcctcgctgacggccttggccaccgtgccggccgccgcctcctccaccaggacgatcgccgagcctccgaagccgccgccggtcatgcgcgcaccgagcgccccggcctcgttcgccgcctcgaccaccaggtccagttcggggcaggagacccgcaggtcgtcgcggagcgagcggtggccctcggtcaggacggggcccgcggcgcggacgtcgcccgcgtcgagcagcgcgatgacctgctcgacccggcggttgtcgccgacgacatgggtgacgtagcggacgacggattcgtccgctccggcgtcggcgagcgtggtgagcgccgcggcgaggtcctcgtgacgcaggtcgcggagcatcggtatgccgagcagccgggcgccctcctcgcagccggcccggcgctccgcgtacgccccgtcgccgagcgcgtgcttgacccgggtgtcgacgaccaggagcgtcagaccctgggaggccaggtcgaaggggacctggcgcagggagaggtcccgggtgtccaggtggagggcgtggccctcggtgcagcaggccgaggccatctggtccatgatcccgcagggcacgccgacgaagtcgttctcggcgcggcggccgacgacagcgagttcgggtccggtgaggccgaggtggaagaggtcgttcagggccagcgcggtgacgacttcgagggcggcggaggaggagagtccggcccccgtcggcacggtggaggtcagcgcgatgtccgccccggtgaccgggtgcccggcctcgcggagcgcccagaccactccggcgggataggcggcccagccgtggcccgcgtgcgggacgagttcgtcgacgcgcagcgagacgacgccgccggggacgtcggaggagtacaggcgcaggacgccgtcgtcgcggcgggagacggccgcgcgtgcggcgtgcgggagggcgagcggcatgacgaagccgtcgttgaagtcggtgtactccccgatgaggttcacccgtccgggtgccgcccagatgccgtcgggctcgcttccgtacagatcggcgaaggtggcggcggggtcggtcccgtacgcctcgttggtctcggtcatggggtggcggtgtcctctcggcgggcgaactgccaggcgtcggcgatgattccggccaggtcggcgcgggacggcgtccagccg

SEQ ID NO: 4133 - DNA, 1354 bp, Unknown
  Kingdom: Bacteria, Phylum: Actinobacteria, Class: Actinobacteria, Order: Streptomycetales, Family: Streptomycetaceae, Genus: Streptomyces
gcggcgacaacgccctgctggccgccgaacacggcctggagacgacgggggtggacgccgcgcccagcgcgatctccctcgccgtcggcaaagcgcgcgaacgcggactgaaggcgcggttcctggaatgggacgctctggacctcgcagcgctcggcgagcagttcgacacgctcatcgacgtcgggctcttccactgcttcgcacccgaggaccggcccctcgtcgcccgcagcatggcctccgtcgtgccgcccggcggacgctgcttcctgatgtgcttcagcgaccggcagccgggcacctggggtccgcgacgcgttcccgagcaggccgtccgggagagtttcaccggcgccgggtggcgcgtggacacgctcgaagcagccgaactcgacgtcgccttccgccctggggtcgcccaggcctggttcgccgccatgacccgcgtctgagcgggtcggagagaagacgaccatgcgcgtcctgttctgcacctggcccgccgcggcccacctctaccccagcgtgccgatggcccaggccctgcgcgacgcgggtcacgaggtgcgggtcatctcccacccgtcgctgctggacacgatcaacgcgacgggactctcgggggtgtcgctcagcgacgcgccgaccctgccgcagccgctgggcgccggccgccccatctcgccggacacgtacgccgacctcgtccgcatcaccaagtccctcgaactggacggctacgagcgatacgtgtggacctactaccgggactacatgctgccggccgtccgcgacttccaaccggagggcgctcccgccgacgaaccccagtacgccctcgacgcgctggtcggcttctgccgttcctggcggcccgatctggtcctgtgggacccgacgatgccggccgccggtgtggccgcccgggtgtccggcgctgcccacgcccgcatcctgtggggcccggaccttctgggctgggcgcacgagcagtacacccggtgccggaagctctccggtgacgccctcctgcccgaggagccgatgacctcgtcggtcaggccgatggccgagcgctacggactccccatgaccgacgagctgctgttcggacagtggacggtcaacccggtgctggagcggatgcgcctgcccaccgtgaagcgcaccgtgtcggtgcgctgggaggcctacaccggcccggccgtgctccccgagtggctgaaggaaccgcccgcgcgaccgcgggtggccatcaccctcggttcctcgatccgggcctggggacgggacagcgccctgctcgtcaaccgcgtactggagatggtggacggcctcgacgtcgaggccg

SEQ ID NO: 4134 - DNA, 563 bp, Unknown
  Kingdom: Bacteria, Phylum: Actinobacteria, Class: Actinobacteria, Order: Streptomycetales, Family: Streptomycetaceae, Genus: Streptomyces
cgggtcggcggccagctcggcgaacgcggaccggccggccgacgggtaggccagcaggacgtcgtcgaacccggcccgcgccagccacagcgactccgccagcgtgtacgacatgatcccggcgaacccgggacgcgcgagcacccgctccagcagggcccggcaccgcaccgatttgctcgccacccggaccggctttccggccgcccgccgcaccagatcgtcggcgttggcgtcgaacgcctcaagatcgacgatcgcgatcggggcatcgagatgggcggtggcccggttgtagcgggtccggtcagcggcgcgggcagtcatggccgcagcttgccagagtgccgctacggctgggtagggggacgatcaggacagatcctccgccgaccggggcgtcccgttccccgccgcccgtccgcagcccgtagagtgacgtgcacgcgagcaccaacgggcctgtcagcggcggtgatccgtggtcggtacgaggatgtgtaagcagggggccggatgagtaccgaagcacagcgcacccctgtgccgccccgccccaccac

SEQ ID NO: 4135 - DNA, 1655 bp, Unknown
  Kingdom: Bacteria, Phylum: Actinobacteria, Class: Actinobacteria, Order: Streptomycetales, Family: Streptomycetaceae, Genus: Streptomyces
ggtcggcgcggggcggcgagttcgaggagttcgcggccgccctgcgcgaggcgatgcgaccgctgccggtgcggctggtcgagagctcctaggtcgtgtccgcaaagcagcgccgtccgcgcggaacgacggcaggggcccctgtctccaggacccctgccgtacgcggtcgtgcgggtgtcactcggtgcgcagtccgtccgggcgcatcatgcgccacagcggcggcagcgacagcagggtgaccagcaggatcagcccgcctccgacccccgccagcggccagaacagccaccagtcggagacctccttctggatcaggtggacgagcatcgccccgaggcccagaccacccgcgaccgccaacgccagaccgagcgccaccggcacggcggtctgccacagcaccgaccagccgagcgtggagcgccgggtgccgaaggccaccagcaccgacagcagccgcctgcgctcacgcaactgctccagctgggagaccagcatcgacagggcgatcaacagcagcaccgcgctcgcgcccacctggagcccggtctggatgctggcgtactggcggtcgcgttccaccgagtcgagcgtgacgaagcgcatgccggggtcgatcctggccgccgtgttgcgtacgtgctcggcgacgtccggcacgctccggtcgacccggatctgggtggtgatcgtcgcgtccggcagcttgccggcgtcgaccgcgccgatggtggccatgatcccccagtgggagtcgcccatcgggtcggtgcggcccgtcacggtccgggaatcggcgggcagcgtccaccgcatcggcttcttcccggagccgatctcgaccaccttgcccttgcgggcggtcctgtcgacccaggcggtcatgtccttgtcgtcctgcgggtggacgacgaacgtgtcgccgtcctcgcaggcgccgatccgggccagctcgcgcagggtctcgcaggtgccgacggtcagcgaggtggtgggctggatcgcgtcctcggcgtagtcgccgggcttgctcgcgaacgcttccaccgagccgatgaccacctccacacccttggtcgcgcggaactgctcgatcgccgcggtggccccttcgcccgtgacgttctcggagtagccggcgaactgggcccgggtggggtcctggcccgtcatccggttgaagtcggcgttcatcgaggcgaacagcatctggagggcgatcgctcccgccaccgccaccgtgaccccgctgaccgcgcgggacgcggccccgctgctcagctggagcctgcgggtggcgagctgccagggcaccgggccgccgcgcagccggttcacacaggcctcgaccagccagggcagcagcagggcgagtccgaacagcaccagcacggcgccggcggtgatcgggaacggattcaccggtgcgtactcctcgacccggccccagagcgcgagcaccgcgaggcccgccagcggtaccggcagccgccaccacaggcggcgtccccggtcgcgaccccggcgcacgacgccgagcggctcgatcaccacggaccgcatcgccaccagggtgacgaggacggccgtcagcggcacagccaccgcgatcagcgacgccagccggaggtcgggcgccaggtcggccg

SEQ ID NO: 4136 - DNA, 3533 bp, Unknown
  Kingdom: Bacteria, Phylum: Actinobacteria, Class: Actinobacteria, Order: Streptomycetales, Family: Streptomycetaceae, Genus: Streptomyces
cacgcgcagctcaccggtctccgccagccgggcgttctccgcgagacggtcggccgagggtccgccgccgccggaggagaaggccacgcccagctcggccgcgtccccgtccgcgatggtgacgatccggtcggtcgtgccgccgcgcagttcgatggaggcgggcagcgcgccgcgccccgacgcgtcgaacaccgcgtccacgccctccgggaccagctcccggacccgctcgaccagcccgtccccgtacgccaccgggaccgcgcccagcacccgcagatagtcgtggttggccggggaagcagtgccgatgacggtcgcgccgcgggccaccgcgagctgtacggcgacggagccgacgccgccgcccgccccgtgcaggagcagcgtctcgccctcggccagagccagttcgtccagcacccgggaggcggtgtcggtcgcgacgggcagcgccgcggcctcctcccaggacagcccctcgggcttgcgcgcgagggaggcggcctcggccagcgcctcggtggcgtaggagccggtggcgctccagccgaggacctcgtcaccgggggcgaactccgtgacgccctctcccgcctccaggaccaccccggcgaactccgcgccgggcgtggcgggcagcggagtggggaaggagccctccatccagccgttccggatcttgtggtcgagcgggttcacgccggccgcccgcacggcgacccggacctggccggggccgggacgcggcgggtcgagacgctccaggtgcagaacgccgggtccgccgaactcctcgtacacgatcgcttccatggagtgatcctcacggctgcggggacgagcggccagtcggcgccccgcctccggagcactgtcagtggcgggtgccagactcgcacccatgaccgaacggtgggcggtggcgactgcggacgggggcggggcgctgctcgcgccgctggccccggacggcctgcccgccgggccggtcctcgccgagcccgacctcgtcgaggcggtccgctcccggcccggggtggtgcgctgggtgtggcggtcgaccgccgagatctacccccggctgctggccgccggggtccgggtcgagcggtgttacgacatcgagtgcgccgagctgctgctgctcgggcacgccggtcggctcggcgagccccgttccgccgccgccgcgctggcccggctggacaacgctccggtgccgccggacccgcccgcccggtccgccgaaccgggcgcgcagtcctccctcttcgagccgccgtcggggaccggagtgccgttcgagggcctgctccgggtctacgcggaccaggtgcgccgccatgacgcggcggagcacccggaccggatgcggctgctgaccgcgtcggagtcggcggggatgctcgtggccgccgagatgcaccgggccgggttgccctggcgcgccgacgtccaccgggaggtgctgaacggactgctgggcgagcggtacgcgggcggcggcgagccccgcaggctcgccgagctggcggacgaggtgtcggcggcgttcggccgacgggtccgacccgacctgcccgccgatgtggtgaaggcgttcgcgcaggcggggatcccggtgaagtcgacccggcggtgggagctggaggagctggaccatccggcggtcgagccgctgatcgcgtacaagaagctgtaccggatctggacggcgcacggctggtcctggctccaggactgggtgcgcgagggccgcttccgccccgagtaccagccgggcggcacggtcagcggccgctggacgaccaacggcggcggggctctccagatccccaaggtgatccggcaggccgtcgtcgccgacgaggggtggcgtctcgtcgtcgcggacgccgaccagatggaaccccgggtgctggcggcgatctcccgcgaccggggcctgatggaggtggccggtcatgacggcgacctctacaaggcgttgtccgaccgggcgttctccggcgaccgcgagcacgccaagctggcgctgctcggtgcgatctacggccagacgtccggggacgggctgaagaacctggccgccctgcgccgccgcttcccgctcgccgtcgcctatgtcgacgacgcggcgcgggcgggcgaggagggacgcctggtgcggacctggctgggccggaccagcccgccggtcgcactggcgggccaggacgaggaggcgggccttccccaggagggtcccgagggttccgcggccgcgtccgacggcggtccggcgcgggcccggggtcgcttcacccgtaacttcgtggtgcagggcagcgcggccgactgggcactgctgctgctggccgcgctgcgccgtgcgctcttcgagcaggggctgcgggcgcagttggtgttcttccagcacgacgaggtgatcgtgcactgcccggccggggagaccgcggccgtcgccgaggcgatccgcgcggcgggcgagctggccgggcggaccgccttcggggagacgccggtgcgattccccttcacgacggcggtggtggagcggtacgcggacgccaagtgaccgggcgggcgaccggacgcacgccgaaccgcccggggtgccggttacgacgcctggagctccagccactccgggctggtcgccagggcgacgagctggtccatggtgagcgcgggctctttcggacgatccgcgagaacttttccgggcccgggtccggacagcgcggaggcacgcgagaagcgccccgttcacgcgccggacggcgtgaacggggcgcgggcggtggtgcgctcgctgttcctcgtctacccgcgttcccacaacgcggggacgttcggcggctcccagcccgcatgggcctggtgtgcctgcagacagcggtaggcgaccccgccgtacgtcacgcggtcacccgcgcggtaggaggtgccggcggcccaggtggtggaccccggctcggtgggcggatcggtcgggttgggcgtctgggcgacgtccagcacgaagtcgaaggtgccctggcgcccgttcccgacgttgcggacgttcatcagcagctcggggtcgaacagcgcgtcggtgttgttgcgcggctcgttcgggaagtacagctgggtggtgaggatgcgcccgccgggcgcctgagccttcacgtggatgtgccgcgtgcggcccgggtagagacccgccacgatggtggtgaggctgaacgacccgtcggtaccggtgaactggtgcccccggaaggcgaactgggccatgtcgtacgcaccgttggtgtccgcctgccagaagtccagcagtgctccggagatgggccggcaggcccggccgaagacgtagccgctcacggtgagcggtatgccgggggtgctcggggtcaccaggctggtgcggcggggggagttgggcttgaagtacggcccttccatctgcggcggcgtcgtgtcgtcgccgtcgtcgcactccggggtcggggccaggggcccgttcccggtggaggcgg

SEQ ID NO: 4137 - DNA, 2872 bp, Unknown
  Kingdom: Bacteria, Phylum: Actinobacteria, Class: Actinobacteria, Order: Streptomycetales, Family: Streptomycetaceae, Genus: Streptomyces
gatctgccggtgcccgaggagccgcacctggcgttctggcacgccgcgaccctgctgcgcgagcaccggggcgacgcgcatctcgccgccctgctcgcggccggcctggacccgctcgaatcgctcgtcagccacacggccaccggcaagggcatggcgatcggctgggtcctgtccacccggggctggcgccgcaccgactgggaggcggcgtgcggccggctgcgggagcgcggcctgctggccgccggcgaggagttgacgctgaccgaggcgggcacggcgctgcgcgcggaggtcgaggaggcgacggaccgcatggacaccgccccgtaccagcacctgggcgcggagggcgtggagcggctcaccgaactcgcgcgcggcttcctcttcacggccgccgccgcgggcgccttcccggcctcggcgaccggccggggctgacccgggacggactccggcccgcccggggccccgcaccggtgcggggccccgggcgtgttgcccgaggtcacgcgacacggcccccggccacccggcacaatgcaggccaggggggatgccccccggcaagcaagaacgtgctcatcgcgacacgagcacggccagcacagccagtacgagaaggcgagtcgggaaaaccgtgacgacgtccatcgaaggcaggatcgccgaggagctcggcgtacgtgagcgacaggtcagggcggccgtcgagctgctcgacggcggatcgaccgtgccgttcatcgcgcgctaccgcaaggaggcgaccgaatccctcgacgatgcgcaactgcgcacgctggaggaacggctgcgctatctgcgggagctggaggagcggcgtacgtcgatcctcgactccgtacgcgaacagggcaagctcgacgccgcgctggaggcgagcatccgggccgccgagaccaaggcgcgcctggaggacatctacctgccgttcaagccgaagcgccggacgaaggcgcagatcgcccgggaggcgggcctcgaaccgctggcggacggcctgctccgcgacccgtcggtcgatccgctcgcggcggccgccgcgttcgtggacggcgacaagggcgtcgcggacgcggccgccgccctggacggggcccggtcgatcctcaccgagcggttctccgaggacgccgacctgaccggcgagctgcgcgaacgcatgtggacgcgcggccggctggcggcgaaggtgcgcgagggccaggaggaggccggcgcgaagttcgccgactacttcgacttcgcggagccgttcaccgcgctgccctcgcaccgcgtactcgccatgctgcgcggcgagaaggagaacgtgctcgacctggtcctggaaccggaggagccggaggcggccgagcggccgggcccgtccgcgtacgagaacatgatcgcccgtcgcttcgacatcgcggaccggggccgccccggcgacaagtggctcggtgacaccgtgcgttgggcgtggcggacccggatccaggtgcacctcggcatcgacctgcggctgcggctgcgcacggcggcggaggacgaggcggtgcgggtcttcgcctcgaacctgcgcgacctgctgctcgccgccccggccgggacccgggccacgctgggcctggaccccggtttccgtacgggggtgaaggtcgcggtcgtcgacgccaccggcaaggtggtggccaccgatgtgatccacccgcacgtgcccgcgaacaagtgggaccaggcgctggcgaagctcgcgcacctcgcgaaggaacacgcggtcgacctgatcgcgatcggcaacggcacggcgtcccgcgagacggacaagctcgccggtgaactgatcgacaagcacccggagttgaagctcaccaaggtgatggtctcggaggcgggggcttcggtgtactccgcctccgcgttcgcctcgcaggaactgcccgacatggacgtgtcgctgcgcggcgcggtctccatcgcgcggcggctccaggacccgctggccgagctggtgaagatcgacccgaagtcgatcggcgtcggccagtaccagcacgacctgtccgaggtgaagctgtcccgttcactggacgcggtcgtcgaggactgcgtgaacggggtcggagtggacgtcaacaccgcgtccgcgccgctgctttcacgggtgtcgggcatcagctcggggctcgccgagaacatcgtcgcgcaccgggactccaacggccccttccggtcccgcaaggccctcaaggacgtggcgcggctcggcccgaaggcgtacgagcagtgcgcgggcttcctccggatccggggcggcgacgacccgctcgacggctccagcgtgcaccccgaggcctacccggtggtgcggcggatggggaagtcgtcgggtggcgaggtcgcctcgctgatcggcaacgcggaggccctgcgcgccctgcgggccgcggacttcgtggacgacatgttcgggctgccgaccgtgacggacatcctcaaggaactggagaagccggggcgcgacccgcgtccggcgttccgcacggcgaccttcaaggagggcgtcgagaagctcggcgacctggagcccggcatggtgctggagggcgtcgtgaccaacgtggcggcgttcggcgcgttcgtcgacgtcggcgtccaccaggacggcctggtgcacgtctcggcgctgtcgaagaccttcgtgaaggatccgcgcgacgtcgtgaagcccggggacgtcgtgaaggtcaaggtcatggacgtcgacgtaccgcgcaagcggatctcgctgacgctgcggctggacgatgagcccggcgcgggcggcggctccggcggcgggcagcagggccgcggcgag

SEQ ID NO: 4138 - DNA, 1494 bp, Unknown
  Kingdom: Bacteria, Phylum: Actinobacteria, Class: Actinobacteria, Order: Streptomycetales, Family: Streptomycetaceae, Genus: Streptomyces
  misc_feature (169)..(170): n is a, c, g, or t
ggcccaccccgcccgccgtcgggtccctgccgaagcaggagccgggcagccggcccgcccggccgctcccgtacgccccgtacgtcgacggtgccgtcgacgcgggcaccgggaagatcgcgctcaccttcagcccggggacggccgccggcgcgcagttctacgtcanncgcgccgtggacgtacaccgccgaggcgggcaggacggtgtcggacgcctggaactccgcctactccggcggtgcccacgacctcacggtccatggtcccaacggcttcctccgtacgttcaggagtccgggttccaccgtcggtcccgaggtcaccgcccgccacaacgacgggagcggcaacctcgacctgatcctcaccaaccccggtgacaccgaggtccgcctcaccctctccaacgccgacgtctacgggggagcggagcagtcggtcaccgtccggcccggcgccacggtgtcgcgcaccatggacctgagggcgggaaggcgctggtacgacgtgtccgtcacggccgaggacgacccggtcttcctgcgccgcttcgccggtcatgtggagacgggggccgacggcgtcagcgacccggcaacggccacgggctgacgacgcggaggacccggcagcgaagcggcgggggcccggaccgtctccggtcctggccccgccacgacgccgggcggggccgttcagacggctccgccgacgcctcctccggcaccggaagcggccttgatcccgcgggtgatctcgtccaggacggacagcttcggcgcgtccttgttgacgtcgaacccggaccggaccacgacgagcatgtccttggacgtgggggaggggaacaccagcgattccacgtacccgtcgtcgcccttctccgtcaccaccttccagcgcacgacatagccctcgccgcccgccaccgtgacggcctcggacttcagctcctcgtgcgaggagatcttcccgtagctcttgccgccgtacgactcctgggcgttgagggcgatgtccttcttggccgcctcctcgggcgttcccgcggtgagcttcatggcagcggccggggcggagaacactccgccgcgcacgcaggtctcggcggtgtcgccggggcacgcgtgctcacccgtcgtcagtccggcgccgaccgccccggacgttcccttccaccccttgggcaccggaaggctgatccctgcggccagatccgtggcgaagcccggctcggtcggcgggagctgttcaccgggcccctgaccgtcacccttctccccgtcgttcccctcgccgtccgccgtccctgatccgccgggcgcaccggacgatggcgaggaggacggtgaaaagggcggcgaggggaacgacggggagaagggtgacggtcaggggcccggtgaacagctcccgccgaccgagccgggcttcgccacggatctggccgcagggatcagccttccggtgcccaaggggtggaagggaacg

SEQ ID NO: 4139 - DNA, 3258 bp, Unknown
  Kingdom: Bacteria, Phylum: Actinobacteria, Class: Actinobacteria, Order: Streptomycetales, Family: Streptomycetaceae, Genus: Streptomyces
ggcccgggggaggaagggccggtgctgccctggcagccgcccaggacgttgggcgcgacgacgaaccagcggtcggtgtcgacggcccggcccggaccgaccagcgcgtcccaccagccgggcgtcggatgccccgggccgacggctccggccacatggctgtcgcccgtcagcgcgtgcagcaccagcacggcgttggacccgtccgccgcccgctgtccccaggtctcgtacgccaggcgcacccccggcagccggacgccggactccagggacagtgggtcctcgatcgccacccagcggcgacgaccgggcgggtccccctcccgccggccgccggaggccggcgggagggggtgcgcgcggtgcgggtccgtccggttcaggacgccgccttcgccgcccggaaacccgcctccaggtcggccttcaggtcgtccacgttctccagccccaccgacagccgcaccagaccgggtgtggcgccggtggcgagcaactgctcctcggtgagctgactgtgcgtggtggaggccgggtggatgatcaggctccgtacgtcaccgatgttggcgaggtggctgaacagccctacggcgtccacgaaccggcgtcccgcctcgaccccgtcccgcagctcgaaggccagcacggccccggccccgcgcggcaggtagcgctgcccggcctcgtaccagcggttcgactccagacccgcgtagtgcacggtctccacctcgtcgcgccgctccagccagcgggcgagctccagcgcgttggaggtgtgccgctccagccgcaggctgagcgtctcgacgccctggagcagcaggaacgccgaatgcggcgagagggcgggacccaggtcgcgcagcagttgcacccggagcttcaccgcgaacgcactcgggcccaggtcgggccagtagcgcagtccgtggtagctcgggtcgggatcgtggaagtcggggaaccggtcggcgtggtccccgaagtcgaacgtgccggcgtccacgaccacgccgccgatcgtcgtgccgtgcccgccgaggaacttggtcgccgagtggaccacgatgtccgcgccgtgctcgatcggccgcagcaggaagggggtgggcacggtgttgtcgacgatgagcggcaccccggccgcgtgcgcggtgtccgcgaccccccggacgtccagcacgtcgccgcgcggattgccgagcgtctcggcgaagaacgccttcgtgtggggccggaccgcggcccgccaggcctccaggtcgtccgggtcctcgacgaaggtcacctcgatgccgaaccggggaagcgtgtgacggaagaggttgtaggtgccgccgtacagcgacggggaggagacgatgtgacccccggccccggccagcgtcaggatcgccagcgtctcggcggcctgccccgaagccagcgcgacggcggcgaccccgccttccagcgcggcgatgcgctgctccaggacgtcctgggtggggttgtggatgcgggtgtagatgttgcccggttcggccaacgagaacacgtcggccgcgtgctgcgtgtcgcggaagacgaaggacgtcgactggtagatcggcaccgcgcgggcgccggtcgtcgggtccggggccgcgccggagtggatctgcttggtctcgaacgaccaggcggagccgggttcctgacggttccggtcctcgggggtgtggcctgcggtgacggagtcgaggggctggctcatgtggttcctcgcacggggcggtgacggctgaatacggaccgtaggccgctctccgcaccttcggaagcgtgtcgcccgcccggccacgaacccgcaacggcgcgtcatgctccgcaacacggcggcaacggggaatccatacccggccgctccggacacgccgctcgccgtcaccgccccgccccggcgcgggtggtgacggcggcggagtacggagccggctcagcggaccgccgggacctcggcgatggagcgacccgcccacgcgggcgccggctcgacgagcgcggccagccgctcccgtacggaatccgggaacgggacggtgcggcccgcacgttggtccacatggagcgccagcagctcgctcgtcgccaccggggcggcctccggctccggtgcggcgtccggcgcgccgaccacgtacagctcgtggctgaagcgcgccttcttcgcgtccactcccaacaggcgggtccggaccgcgacatgggcgccctcggccacgtcgcggagatagcgcagatgcgactcgacggtgtagagcgagcagccggtgctttcccggtatccggcgtgcagaccggtctcgatcatcatcgcgtcggtggcgtacccgaagaccaggacgtagaacgcctcgctcatatggccgttgtagtcgatccactcgggccgtaccgtccggtggaccagggggagcgccgtggtgtcctcggcctccgtggtgcccgtggcgtccgcggtgtgctcgtcgggtgtccgccgctcgctcatcgggtcgcctcctcggcggtcccgggcaggcggcccgtcgcccgcaggacgtcgatgacgccccggtcccgttcggcgaccaggtcggcgatgctccggccgtccgccgcctcctcgcagccggccaccaccgcctcgtacagggcacggtccagttcgggtgcttcgagccgggtccagggggacttcagcgacgggccgaagtggtcgagcatgtgggccatcccgccctcgccgcccgcgagtgcgaaggtcagcatcggacccatcacggcccagcggagccccggaccctcggtgatcgacgcgtcgatctcccgtaccgtcgcctcgccactggcgaccatgtgcagggcttcgcgccacagggcctcctggagccggttggctatgaagccgggcacctcgcggtccatggtgatcacggacttgcccgcgacggtgtagaagcgcgaggcccagtcgaccgcggcgggcgcggtccgttcaccgccgacgacctcgaccaggggaatgaggtagggcgggttgaagggatggccgacgacgagccgcccggggtcggcggcctccgtctgcatgtccgtcatcggatagccggaggtcgacgaggcgatcaccgtgccggcgggtgcggcggcgtccagccgggccagtaggtcgcgcttcaggtccagcttctcgggggcgctctcctggacgaactgggcgtcggccacggcctcttcgagggtcgc

SEQ ID NO: 4140 - DNA, 615 bp, Unknown
  Kingdom: Bacteria, Phylum: Actinobacteria, Class: Actinobacteria, Order: Streptomycetales, Family: Streptomycetaceae, Genus: Streptomyces
cggcctcgacctcggccggcggtccggtgtgcccggcggtcccgtacaggaagtcatcgatcatggctccagctaagcacggccggacgagccctcaccccccgggtgaaagcggacatctccgacgcggagccggatgccggacagtgtccgcaaagtacagccacggaccaaggaattcttgagcccggctcgggctgggaaccgctgctcccccgctcccgggggatggcccgcgaccgggtcgtgttcgccacctcgacctgggtcgatccggtcccgacaggaccgccggccgatgagccggccgcgcacccgatcctcgccgacgtggtcaccgcctggctctcgggcaacgcggaggcgctggtcgcccgcgcggccgggaggcacccggggtgagccgcgccggaagtcctccggatgatgcggaccgccgccgggacaggcgatccgccggacggccgaaagccgcagccacgtcggaagcctctttccggcacacgggggcaggaggcggatcctggccgggctgggcctaccgtcggcctggtcagccaccccgaccaacggagatgtacgacatggcaaagatccttttcgtggtgtccggcg

SEQ ID NO: 4141 - DNA, 1344 bp, Unknown
  Kingdom: Bacteria, Phylum: Actinobacteria, Class: Actinobacteria, Order: Streptomycetales, Family: Streptomycetaceae, Genus: Streptomyces
gtacagcggcatcctcgacgcgatcgaggcggacgggtacgcggtcctgcaccgccgggcggtcgtcccgcgccgacggcgggccgccgtggcgctggacggcctggtgcgggcggtcgccgcacgcagggtgcgccggcgccgagcagacacgttcgcggcggtccggtccgacgggatgtcccggccgcggacggccggcgcccaggccccggtgcgggaggaggccgtatgagcccggcggcaggacgcccgcggtccgggcgcattcccttgcgggtgcgacgcgcgcccgtcccgtgggagcgtcaggcgcccacctggcgcgaggcgaaacccggactcatcacagacgccctcagacgtgcgcagagcaggccttccggcaattggtacgtcatcggcgcctcgcgcgaccttccgcccgggaaggccctcggggtcacggtcggctccacggaagtggtggcgtggcgcgaccgcgggggaaagctgcgcaccggtccgggagcgtgcccgcatctgggggcgccgctgcgcgccagccccgtccgctgcggcacactggtctgccactggcacggactcgcactggacggcgaaccgttcgccggatgggagccctatcccgccttcgacgacggggtccttctctgggtacggctcgaccgcatggggggcgagccgccttcggaacgtccctacgtacccgcccggccaagggtgcgggacgccgtggaggcggtctactccggcgtaggccgctgcgagccggaagacgtggtggccaaccgcctcgatccgtggcacggcgcgtggttccacccgtactccttcgtggacctgacggtgacgggaacccctgccgacagcccggcggacgacgccgggttcaccgtcgatgtgtccttcaaggtggccgggcgtctggtggtgccggtccgggcccggttcatggcgcccgagccccgtacggtcgtcatgcacatcatcgagggcgagggcgcggggtccgtcgtggagacccacgccacacccatcgctccggacgagcggggcaagccccgcacggccgtgacggaggcactggtcgctgcgtcggaccgtcgtggattcgccgtggcccgggccgccgctccgctgctgcgcccgctgatgcgtgcctcggcgggccggttgtggcgggacgacctggcgtacgcggagaggcgctgggaactccgcgaccgcgggacgttcccgggctgacgagtggccccctttcgtaagctccgcagggcccctccgtcagtcggccagcgcggcgagccggcgcagaacggccgaccgtcccgcccgcgggac

SEQ ID NO: 4142 - DNA, 3234 bp, Unknown
  Kingdom: Bacteria, Phylum: Actinobacteria, Class: Actinobacteria, Order: Streptomycetales, Family: Streptomycetaceae, Genus: Streptomyces
gcacgacaccttcgacccggggtgggtgcgggcctggacgcgggccggggccagactcgtcggaggctgctgccgggtggggccggacctcatcacggagctggacgggcggctggagatccagggcccggcgtagggggctgtttccggggccgtcccggagaccacccgacccgggacggggtgaaaatacctggtggggggcagggggtggggatcatactcggacaggtgttcctgacaatcggtacgaccggcacccctgaacgtcccgccacggacctgggttttctgctgcacaagcatcccgacaaggcgcaggcgttctccacctcgcacggctccgcgcacgtcttctatcccgaggcgtccgccgagcgctgcacggccgcactcctgctggaggtggatccggtggcgctggtgcggcgcggcaagggcaagggccggggaggcgcgcccgacgcggcgctcgcgcagtacgtcaacgaccgcccctacgcggcgtcctcgctgttgtcggtcgccctcgccgccgtgttcaagtccgcgctcggcggtgtctgccgggccatgccggagcgggccgggagctcgttgccgctgcggatcgaggtgcccgccctgcccgccaggggtggcgccgagctggtgcgcaagctgttcgcgccgctcggctggtcgcgggtcgaggtcacggccgtaccgctggacgaggagttccccgcgtggggtgactcccgctacgtacgcctcgtgctggagggcgagttgcggctcgccgacgcgctgcggcagctctacgtcctgctcccggtgctcgacgacgccaagcactactgggtcgcgcccgacgaggtggacaagctgctgcgcgcggggaagggctggctggccgaccaccccgagcgaccgctgatcacccggcgctatctgtcccaccgctgggggctcacccgccaggccgaccaggccctggagctggtgcggctcgccgagacggacgacctcgacgtgggatgcgtcgacaacgcggtggacgagagcaccgacaccgaggagaagccggtcccgctcgccgagcatcggcgcaccgcgattctcgacgcgctgcgcgccgccggggcgagccgcgtgctcgatctcggctgcggccagggtcagttggtgcaggcgcttctcaaggatgcgcgcttcaccgagatcgtgggcgtcgacgtctcgatgcgcgccctcaccatcgcctcccggcggctgaagctggaccggatgggggagcgccaggccgaccgggtcaccctgcggcagggttcgctgacctacacggacaagcggctggcgggatacgacgccgccgtgctcagcgaggtcgtcgagcacctggacctgtcccggctgcccgccctggagtacgcggtgttcggcgcggcgcgaccggggacggtgctcgtgaccacaccgaacgtcgagtacaacgtccgctgggagaccctcccggccgggcacgtccggcacggggaccaccgtttcgagtggacccgggccgaattccgggactgggccggccaggtcgccgagcggcacggatacaccgtcgggtacgtgccggtcgggccggacgaccccgaggtggggccgccgacccagatggccgtgttcacccggaccgcggaagccaccggcaccaccgcgaagacggacaggaagacggacaggaagacggacaggcagaccgacaagacggccgacaagacggccgaccggaacatcgggaagaccgagaagaaggaggcggaagccgcatgaacagcgaccacagcaccaccggcgcagaatccgccgccaccgccgcacgcgtcctgccggtgaccgacctctccctcgtcgtcctcatcggcgccagcggatcgggtaagtccaccttcgcccacaagcacttcaagccgaccgagatcgtctcctcggacttctgccggggcctcgtcgccgacgacgagaacgaccagagtgccagccgcgacgccttcgacgtgctgcactacatcgccggcaagcgcctggaggccgggcggctcaccgtgatcgacgccaccagcgtccagtccgagagccgcaagcagctcgtccagctggcccgcaagcacgacgtcctgcccatcgccatcgtcctcgacctccccgaagaggtctgcgccgcccggaacgcggcccgcccggaccgtgcctccatgccgcgccacgtcatccagcggcaccgccgcgagctgcggcgttccctgcgcggcctggagcgcgagggcttccgcaaggtgcacgtcctgcgcaccgaggaggaggccgagagcgccgaagtggtcctggagcgccgctacaacgacctgcgccacctcaccggcccgttcgacatcatcggggacatccacggctgccgttccgagctggacaccctgctcggcaagctcggttacgtggacggcgcccaccccgaagggcgtacggccgtgttcgtcggcgacctcgtcgaccggggtcccgacagccccggcgtgctgcgccgcgtcatgtccatggtgtcggcgggccacgccctgtgcgtccccggcaaccacgagaacaagctcggccgctatctcgcgggccgcaaggtccagctcacccacgggctcgccgagaccgtcgagcagctggaacgcgaggacgccgaacaccccgagttccggggacaggtgcgggagttcatcgacggcctggtcagccactacgtcctggacgacggcaagctggtggtctgtcacgccgggctgcccgagaagtaccacggccgcacctccggccgggtccgctcgcatgctctgtacggggacacgacgggggagaccgacgagttcggcctgcccgtccgctacccgtgggccgaggactaccggggtcgcgccaccgtggtctacggccacaccccggtacccagcacctcctggatcaacaacaccatctgcctggacaccggggccgtcttcggcgggaagatgacggcgctgcgctggccggagcgcgagctggtcgacgtacccgccgagaaggtctggtacgagccggtcaagccgctgaccaccgaggcgcccggaggccgggagggccggccgctggacatcgccgacgtccagggccgccgggtcgtggagacccggcacctgggccgtgtcgccgtgcgcgaggagaacgccgccgccgcgc

SEQ ID NO: 4143 - DNA, 819 bp, Unknown
  Kingdom: Bacteria, Phylum: Actinobacteria, Class: Actinobacteria, Order: Streptomycetales, Family: Streptomycetaceae, Genus: Streptomyces
acgtcgtcgcggatcgcggtgtgggggcaggcgccggtctcgacggcgcggatgcgttcggtgggcaggacgccggccgagcggaggaagcgggcgtcctcgtcggtgtagatgtcgttggtgacgacggccatggagagctcaccggccagttcgcggcagagggtggcgaggatggagctcttgccggtgccgacggggccggcgacgccgatgcgcagcgcgcgcggctggttgagcggctggtggtagtgctcgttggggccctgggccggtggtccgggctgctgggcggaggcgttgtcaggcaaggaagagtctccgttcgcgtcggtcgtgttcgagtgcccaccgctcggtgagcggtggtgtacgggcggggagttcggcgggggtgcgcacggccagtgcctcggtgacggttctcgcggcgtccgcctcggcggcgatgatccacgcgaccgagtcgagggggtcgccgggcagcagcttgagcgcggcggaggcgatggtctgcagttcgtcgtagacgacgccgtgggccagtgcctcctcttctacccccaggacggccccgagcgcccctagggtgaccggtcgcagagggcgcgggcggagccgtgtcagggcggtggccgcgggatggtcgggagccagtcggcgggcgaggcggtgcacgcctcggcccagtgcggcggacgcctcgcgcagcggcgccgtcggcgtccgggcgacgagcgcctcctgcacgggcgcgtagtccaccggatcgcgcagggccgcccgcagggcgagtacggcggcggccgcttcggtgac

SEQ ID NO: 4144 - DNA, 1605 bp, Unknown
  Kingdom: Bacteria, Phylum: Actinobacteria, Class: Actinobacteria, Order: Streptomycetales, Family: Streptomycetaceae, Genus: Streptomyces
gcgtgctgcgcggtgggcggtctgcccgcccaccgcgcagcacgcgatgcgtcagggcaaggtgctggcggacaacctgatcgcctcgctgcgtcatcagccgctccgggactacgtgcacaaggacctgggtctcgtcgtggacctcggcggcaaggacgccgtgtccaagccgctgggcatcgagctgcgcgggctgcccgcgcaggcggtggcgcgcggctaccactggtcggcactgcggacgaacgtcgccaagacccgggtcatgacgaactggatgctgaacgcggtcgccggtgacgacttcgtccgcaccgggttccagtcccgcaagccggcgacgctgcgggacttcgagtacacggacgtctatctgacgccggagcagatcaaggagcacacggcggcgacggtcatcaagcactgagccgacacgcaccgtccgagcgcgtcccggttccccggggcgcgctcacccctgccgggacaggaccgtctccacggtgtccgcctcctgcgcggtcttgtcctcccgatagcgcaggacacgggcgaaccggagggtgaccccggcggggtagcgggtggagcgctggagtccgtcgtaggcgatctccacgacgagttccgggcgtacggtgacgacatggccgtcgtcgtcggtcgccagctcccccagccgctcggtctgccagtccagcagggcgtccgtgaggcccttgaaggtcttgccgagcatcgcgaacgtaccgtcgggccggcgtgcgcccaggtgcaggttggagagcttgccggtgcgccggccgctgccccgctcgacggccagcaccaccaggtccagggtgtgcacgggtttcaccttcagccaggacgcgccccggcggcccgcgctgtaggcggcggtcaggtccttggcgacgacgccctcgtggccgcgttcgagggtgtcggcgaggaacgcgtcggccgccgcgcgggcccgagggtcctccggatcggcgacgagggtgcggcggacccgcaggctctcggggaggagccgggcgagggccgcgtggcggtcggcgaagggccggtcgagcaggtcctcgccgtcgacgagtagcgcgtcgaagaagaccgggacgacgggcacgtgcgccgcggctccggccacgtcccgccgtgagcccacccgggaggcggtctcctggaagggccggggtctgccgtcctcccccagggcgatcagctcgccgtcgaggacgaagcggcgcgcgtcgagcgcggcgacggcggtgaccagttcgggcagccggtcggtgatgtcgtcgagggtccgggtgtaggcgcggatccggtcgccgtcccggtgtacctgcacccggatcccgtcgagtttctcctcgaccgcgcacgggcccagcttgtcgagcgcctcgcgcaccgatgcggcgctctgcgcgagcatcggctggacgggccgtccgacggtgaggtggaaggccccgagcgctccgggtccttccgcgaggaggacgcgggcgacgtcctggagcgatccggcgagcatcacggcgcgccggacgtcggcgggcggggctccggcgcgccgtgatgctc

SEQ ID NO: 4145 - DNA, 1490 bp, Unknown
  Kingdom: Bacteria, Phylum: Actinobacteria, Class: Actinobacteria, Order: Streptomycetales, Family: Streptomycetaceae, Genus: Streptomyces
ccggcggcgcgggcgggccggtccccgtgccgccgacggtgtccgtgggggtggcgtcctcggtcttcacgctggcacgctatgcacaccgggcggcgaccgggcggtacggcagggccgtgtcaccgaaccgtcagattcgctcttccggcggcgatgcccgttccctcatccgcccgcgacgtcagagtttcgtcaggagtcgcgtccgcccgcatgctctgttccccgcttagcgtcggccccatgcccgaacgtcgtcgcatccgctccctccccggccccctccgcgccccgcgcacgcctgccgacccggcgttctggcgcagccctgtgcgcggagtgcgcttcaccgccgcgctcggcgtcatcctgctcgtcgggctcacgctggtgttcgtcaccggtctgctctcgtacgccgcctacaacccggacctgaaccgggtcaacgacaaaaccccgggcaaggggtggctcggcttctatctgttcccctggccgaccgacccgcactggctctaccggctgacccagggcctgcacgtcaccgtcggcatcgtgctcgtgcccgtcctgctcgccaagctctggtcggtgatcccccggctcttcgcgctgccgcccgcccgttccgtgggccacgcgctggagcggatctcgctgctgctgctcgtgggcggggcgctgttcgagttcctcaccggcctgctcaacatccagctggactacctcttccccgggtccttctacaccctgcacttctacggggcctgggtcttcctcgccgggttcgtcacccatgtggccctcaagctgccccaggccgtacgggtgttgcgccacggcatcccgcgcggcgaaccggacaccctcgccgcccccgacccgctgcccgccaccctgtcccggcgcggcgcgctggccctcgtgggggccgggtcgctccttctgctggtcacctcggccggtcgcagcttcgacgggccgctgcgccgcatcgccctcctcaccccgcgcggcggcaccgagccgggaccggggccgaatgccttcccgatcaacaagaccgccgccgccgtacggatcaggcccgccgacaccggtgagcgctggcggctgacggtacgggggccggccggggagtttcgcttctcccgggtcgagttgctggccatggaacagcacagcgccgcgctcccgatcgcctgcgtggagggctggtcgacctcggaccaggagtggcgcggggtgcggctctccgatctggcggcgctcgccggatacccgcaccggccgccgggcgtgttcgttgattctcttcagcgcagcggctcgttccgcagcgccgcgctgcgcgacaaccaggtccgcgacggccgctcgctgctcgcgctggaggtgaacggggcgccgctgtcgcccgaccacggctacccggcccggatcatcgtccccgccgcgcccggggtgctgaacaccaagtgggt

SEQ ID NO: 4146 - DNA, 666 bp, Unknown
  Kingdom: Bacteria, Phylum: Actinobacteria, Class: Actinobacteria, Order: Streptomycetales, Family: Streptomycetaceae, Genus: Streptomyces
gagccggtgcgctcggccagctccagcgcctgctcgtacgcccccgtcgccacctccggccggtccgccgcgtgcacgtcggccacgccgagcagggcccgggtgcgttcgtaggcgctgtggatccttcgggccacctcctccgccgcggtgaagtggagcagcgcctcgccggtgtcgccgttctcggcgtacgcggcgcccataccgatcagcgcgttcgcctcgcccagtgcgtccccccgggcccggtggctctccagcgctctccggaaaccgtccagcgctcgcgacgtgtcccccatggcctggtgcaccgcaccaagattggtgtccaggatcgccagctcctgggctccgctgtgcaggcgggccagcaccctcgaccgttcgagatggtcgtgggcacgctcgatgcggccctggagctggtggatctcgccgatgttgttgtgcgcgcggatctgtcccagcaggtcgcccgtcccctcgtggatgtgcagcgtgagccgggcccggccgagcgcctcgtcgtaccggccctcgtagtacagcgcggccccctcgacgttcaggcagtccgcctcaccgtgcagatcgcccagatcgcggtagagcgccagtgcccgcgccaccatgcgcagcgccgggccggtgtgtccggcg

SEQ ID NO: 4147 - DNA, 562 bp, Unknown
  Kingdom: Bacteria, Phylum: Actinobacteria, Class: Actinobacteria, Order: Streptomycetales, Family: Streptomycetaceae, Genus: Streptomyces
agcgcgccgttgacggcgtcgatcagagcgcgcggcgttctggcgtcggtcagcgtgtcgtcgtccaacgtgacgtcgagctcgcgctcgatgcggctgccggtctccagcatggccaacgactcgtagccgagcgattcgaagtcgacgtcgaggatgtctccgtcgaggtcgacgctctcgtccgcgccggcgccctcgcgcaggatgcgcttcaggtcatcgacggtgaactcgtgtgcagacatgaatggctgtcctttcatctgggtgggacggtcactgcggtggtccgggccgggaggcctccgccgggccggggcagcacgtgcccaggggtgtccgacggatcaccccctagacgacgcgcgccaccagcgcggagttgaagccgccgtggccgcgggcgatcaccagggcggagcggaccgtcgcggcgcgctcctccccgacgaccaggtccaggtcgtaccgggggtcgggggtgacgccgatggagggcgggatcactccgtcgcgcatggcgaggaacgcagcggccacatccagcggtcccgcgccc

SEQ ID NO: 4148 - DNA, 2592 bp, Unknown
  Kingdom: Bacteria, Phylum: Actinobacteria, Class: Actinobacteria, Order: Streptomycetales, Family: Streptomycetaceae, Genus: Streptomyces
gctctccgatgcgctgccggaagagggcgtcactctccagcgcggcggccatcgcgttccccgcgaacttcgcccgccgggtcggggtgaaccgggcgtactgccgtagctgggcgggcagttcggagacggtcaggccaccgaaggcgtccgagaccagcgcgatcacccgccgtcggacaccctcgggcagcggacggccgagcacctccgcaccgccgtcggcctcatcggccggtccggcgccgctggtcggctgatccaccgtccgtcaccccatagatatgtcgaagggtgcgctccctcaggaagcggcacccggcctgtccaccagttcgatctggtccaccgcgttgcaccaacgacagcggaccgactcgatggtctcactgacgacctcccgctcctcgacactcgactcaccggccaggtcgaggtgcacgtactccacgaccttggaggaacgggtcacgtcgaagcgcgtgaggttgccgcacagcgtgcagcgccagcgggtcgagtcggtcggcaggggaaccgtcgtcatcgtttgcgtcctctttcgtcgtttccaggagcccgcgccgggcgcgccgccgcgactccacctgtctacgtcaaggatctcgcggtgcgccgtcgaactgcggaagtcctggcgtaaccctacggcctcgcgtataggcatcggcacggcgaggcgctccgtcccgttctccgccggtacgtcatgctctgtacatgatcgattggcggcagaccgactggcggaccacggccgggcggatccgggacgcggcggcgtcgggcggcgctccggtcacgtacggactgatcgccgtctgcggggtggtcttcctgatcagcccgctctccgggttcggcggcgccgcccacgggagcgaggacgcgctgctcgccgcgcaggcggggtacttcgagcggtggggggtgatccccgccgagctgtgggaggggtcggcacacgcgctgatcaccccgttcaccgcactgttcgtgcacggcagctggctgcacctgctggggaacctgttgttcctgtacgtgttcggcgcgatggccgaggagcgcatgggccgggtgccgttcgccctgttctacgtgggctgcggctatgtggccctggtctgctacgcggcggcgcacgcggactccgagcagacgctggtcggggcgtcgggggcgatctccgcggtgctcggcgcgtttctctacctgttccccaggacccgggtgaccagcctgttcccgttcctcttcttcctgccgctgcgcttccccgcctggatcgtgctggtcttctggttcgggctccagtgggcggcggcgcagggggcgggcagcggtcccggggtcgcgtacctggcgcatgtggcgggcttcgcggccgggttcctgtacgcctggggactccatgggcgtaggactagagtgaaggttccagccaccgagggagacagccagccgtgatcaccgcgatcgtgctcatcaagaccagcgtggaccggattccggagatcgccgaggccatcgccgcgctggacagcgtcagcgaggtcttctccgtcaccggcacctacgacctgatcgccatggtccgggtcgccaagcacgacgacctcgccgacgtcatccccggccgcatcagcaagatcccgggcgtcgagggcaccgacacccacgtggcgttccgcacgtactcccagcacgacctggaagcggccttcgccatcggcctcgacgcgtaggcacaccggcgacgcgcctcggccggggacgggcggcacgcctgtccccggccgaggtgtttcatcagaacgtgtcccggacctgggtggcttcgccgcggtccgggacgcagcggccgtcctcggtgcggtagttccaccgggctccctcgcggaccagctcggagaccgcgcgcaggaaccggtcgatgtgctcgtcgggcgtaccggcaccgaagctgacgcggatcgcgttcagcgagcgctcacccggctcggcctccggcgctccgcacgcgcccgggtcctgcgggtcactgccgagcagggtgcgcaccaacgggtgggcgcagaacaggccgtcgcgcacgccgatgccgtactcggcggagagggcggcggcgaagtgcgagctgttccagccgcgcaccacgaaggagatgacgccgacccggggagcgtcgtcgccgaacagcgagagcacctgcacctcgggcacctcggcgagaccctcacggacccggcccacgagctcctgctcccgggcgaccagaccgtcgaagcccgcctcggtcagggccttgcaggcggaggcgatggagtagacgccgatgacgttgggtgaaccggcctcgtggcgggcggccgtggtgtgccagtcgacgtcaccttgcgggaggcgccgccgcccgcgaggtacggctcggcggcctggagccagtcggcgcggccggccaggaccccggagccgaagggcgcgtacagcttgtggccggagaacgcgacccagtcgacgtccagttcggcgatgtccacggggtggtgcggggccagctgggcggcg

SEQ ID NO: 4149 - DNA, 1605 bp, Unknown
  Kingdom: Bacteria, Phylum: Actinobacteria, Class: Actinobacteria, Order: Streptomycetales, Family: Streptomycetaceae, Genus: Streptomyces
gacgagcccaccaaccacctcgacgtcgagggcatctcctggctggccggccacctgcggacccggcgctccgccctcgtctgcgtcacccacgaccggtggttcctcgaccaggtctgcacccgcatgtgggacgtccagcgcggcaccgtccacgagtacgagggcggctacagcgactacgtgttcgcccgtgccgagcgggagcgcatcgccgccaccgaggagtccaagcggcagaacctcatgcgcaaggagctggcctggctgcgccgcggcgcccccgcccgtacctccaagccgcgctaccgcatcgaggccgccaacgagctcatcgccgacgtgccgccgccgcgcgacaccagcgagctgatgaagttcgccaacgcccgcctcggcaagaccgtgttcgacctggaggacgtgaccgtccaggccgggcccaagaccctcctcacccacctcacctggcagctcggccccggcgaccgcatcggcctggtcggcgtcaacggcgcgggcaagacctcgctgctgcgcgcgctcgccgaggccgcccgcacccagggcgacgagcagcccgccgccgggaaggtcgtcgtcggcaagaccgtcaagctcgcctacctctcccaggaggtcaccgagctgaacccgaacctccgggtcctggaggccgtccagcaggtgcgcgaccgggtcgacctcggcaagggccgcgagatgaccgccggtcagctctgcgagcagttcggcttcaccaaggagaagcagtggacacccgtcggcgacctctccggcggtgagcgccgccggctccagatcctgcggctgctgatggacgagccgaacgtcctcttcctcgacgagcccaccaacgacctcgacatcgagaccctgacccagctggaggacctcctcgacggctggcccgggtcgatgatcgtgatctcccacgaccggttcttcatcgagcggaccacggaccgggtcatggcactcctcggcgaccgcgccctgcggatgctgccgcgcgggatcgacgaatacctggagcgccggcagcggatggaggaggagtccaccccctccgccgccgcaccccgcccgtcctcggcccccgcagccgctccggcggtctcggcgcaggaggcccgcgccgcgaagaaggagctgcagaaggtcgagcgtcagctcgacaagctctccacccgcgagaccaagctgcacgcccagatcgccgagaacgccaccgacttcgagaaggtcgccggactcgacgcggagctgcgcgaactcgtcaccgagcgcgacgagttggagatgcgctggctggagctggccgaggacgcctgacggggaccgccgcggcgggtggtagaacaggacggcaggggccgtacgttcgagggggaccacaccgatgtcgcagccgccgccgcagggcgggccgggggaacaggagggcttcggcgccccgttcgaaccgcagcccggtgtgtacggaacccccgtgccaccccggcaccagccgcagccgggcccgtacggtcggccgttccagccgccgtacggccacccgcagccgcccaccggtccgtacgg

SEQ ID NO: 4150 - DNA, 2481 bp, Unknown
  Kingdom: Bacteria, Phylum: Actinobacteria, Class: Actinobacteria, Order: Streptomycetales, Family: Streptomycetaceae, Genus: Streptomyces
accccgaccaccgccgaggcccccatggacggtcgaccggcccaccggcagccgtgggaacgggcgatcctcgccagctcgctccccggcaatcaccgcttcgtcgccatcgccctgtcgacccacgccgacggacgcgggcacatcgcccgccagccccgcgtgatcggcctcgtccacgccaccgggctgcacgtcggccaggtgcgcgtcgccctcgccaccctggtcgaccgcggcttcctccgccggcccccggccgacagccccatcgacaacgtcgacctggtcctcactctccccccgggcgctctcgcccgcgcccgccgcgcccaccaggccaccaccaaccggagttctaccgatgcataagaccccgcagcactgggccgagtcgctggccgactccgtgtacgccctgtacgagacggccaacgagtaccgcaacgcctgccgggccgctcagctccaggccaccaccgtcgacttcctccggcgcatgacccacgagggccgcatcggactggagggccccaccgccggatacggccgcgcctccacccgcagcccgcacggccaggccctgaccgtccttcaccgcctgtacggcacggtcgaatccgagacggcggggcactacgaggaggccgccctcctctacgcgtccggcgcggcctgggcggcccgcgcggtacagcgcggtgagcggcccccggtggtcgtgttccgggtcgacgaccacggcgacccggccccgcactccatggacgtccccggcctggacacctgggtcgacggcccggccctggacgccgcctacaacaccctcatgcgctgcatggacgccgccgagtacggcgaggacctggcggaccgggactacgtcagcgaccacgaggccggagagatgcaccgcgccctcggcgaggccggcggcctggccgacgccgcgttcgcctacggcctcctcgcccagcgcgccgtctccttctccctcatcaccgcacgccgcgcccgcgagtccgagctcgctcaggcccacgccgccgcccagaccgaacggccctcggagccgtcggcctgatgtcctccgctctgctcgccaccgctgagccccgccgcacccgcggcggggccagcagtgctgtgcgctacaaccggccccgccggcgcgccgagcagagcgtctggatccccgaatccctctaccggggcgacgactacaacgacgaggcggcggccgtctacatcaaggtcgccgccctggacgcccgccgcacgtggcccgcgtcccgcccggacgaggacccgtgcaccgcccgggtcgcggagctcgccgccgcgctcggcatgtccccgtccgccgtggaacgcggcctcacccagctcaaccgacccggccctgaaggcgagccgtggctccggacgaagcaacgcacccaccgcggcggcgacgggcgctccgccctgcgctacgcccgcctcgtcccgcgcgaccagcccgccctggaggttcctgttcgggtcgccgaggccctgaccccgcgccgcctgcgcgcctggctccacctcgcccgcgccaccgcccaaggcctcccggtcaccgcggccgagcttgccggggagctgcgccaccacagcggcaagagcgccgggaagccgctgtgtgagaagacgggccgcgccctgctgaatgacctggaggccaccgggtggctcaccctcggccgcagggccgggcagcgcgcccgccacgccgtcaccgtcaacaccagcccgctgcacgctgtccccgccgtcccggccccggctgtggacgacgatgtggacgacgccctgttccccgtctccgagctgctggccccgcccgctacggacatccatgacggggtgggtccggacgatcaagacgggtccctcgcgactagggaagacagctcctctacaactgacgggcgcgcgggcaatctttcgatccgccggaggcgagactcgggtagttacgggccccggcctgtggaaaacccggttgctccgacgttccagagcgcggctcaagacgaaaagcgcagcaacaacggcgacggcacgacgtaccgcgggccgggactgcagctgtcgccccgggtgtggcaggtcctcgagcccgtacgccacgaactccccagcatccagacctgggtactgcgccggatcggccgggagatcggcgtacagctgtccgccggggtcggggccgagcgcctcacgacccggctcctgacccggtactcccggctcactgcccgcggccccgccgccgagcacgctcggcgcggcgacgtcggccggtggatcctcggcgcaggcctgccccgccacggatgccgcctgccctcctgcgaggacggcaccacctgggccaccggggagcgctgccacctctgcgccaacatcgccgccgaggcctccgccatcgaggagacccgggcgcagcagccc

SEQ ID NO: 4151 - DNA, 1525 bp, Unknown
  Kingdom: Bacteria, Phylum: Actinobacteria, Class: Actinobacteria, Order: Streptomycetales, Family: Streptomycetaceae, Genus: Streptomyces
acgtcgcggccaagcacggcgtcgtcggcctcaccaagaccgccgcgctcgaatacgccgggcagaacgtccggatcaacgcggtcggacccggcttcatcgacaccccgctcctgcggaacaccgccccgggggcccgcgagcacctgatctccctgcacccggccggacgcctcggcaccgccgaggaggtcgccgaactcgccgccttcctgctctccgacaaggcctccttcatccacggcagctaccacctggtggacggcggttactccgccccgtgacggagcccgagtggcgcgcgggggacacgggggcgacaaaagaagcacggggcgacagagcgagacaaggaagaagcgaggagaccccatgagagccgttcagtaccgagccgtcggcgccgcccccgaggtggtcaccgttccggaccccgagcccggccccggccaagtcctgctgaaggtcaccgccgccggcgtctgccactccgacatcgccgtgatgagctggcccgccgaccagatccccttcccgctgcccctcaccctggggcacgagggcgtcggcacggtcgccgccctcggcgacggcgtcgacggcttcgccctcggcgactccgtcgcggtgtacgggccctggggctgcggcacctgtgtgaactgcgcagaaggcaaggagaactactgcctgcgcgcccaggagctcggcatcatgccgcccggactcggtgcacccggcgcgatggccgagtacatgatcgtcgacgatccccgccacctgatcccgatcggcgacctcgacccggtgaagacggtgcccctcaccgacgccggactgaccccgtaccacgcgatcgtgcgctccctggcgaagctcgttcccggctccaccgccgtcgtcatcggcaccggcggcctcggccacgtcgcgacccagctgctgcgcgccatgacggccgcccgggtgatcgccctcgacgtcaccgaggacaagctcgccctggccaggaccgtcggcgcgcacgaagccgtcctctccgacgagaaggcggcggcccgcgtcatggaactgaccggcggactcggcgcccacgtggtcctcgacttcgtcggagcaccgcccaccgtggcgaccgccggagccgtcgcccgcgtcgacggcgacgtcaccatcgtcggcatcggcggcggcgcgctgccggtcggcttcgggacgctcccgtacggcgccaacgtcagcgcgccctactggggctcgcgcaaggaactcgccgaggtcctcgacctggcccacgccggagcggtggacgttcacgtggagacgtactccctcgacgaggctccgctcgcctacgagcgcctccacgacggcaggatcaacggccgggccgtcatcctcccgagcggctgaacccctcccgcaccaggcggctgaacctcccggcggtccccgcggcgccgacgtccgcccgtccgccccggcggcgccccccggatccttcccggcggccgccgccggggcg

SEQ ID NO: 4152 - DNA, 658 bp, Unknown
  Kingdom: Bacteria, Phylum: Actinobacteria, Class: Actinobacteria, Order: Streptomycetales, Family: Streptomycetaceae, Genus: Streptomyces
cggcgccagcgagaacaacaccatcaagatcgcggacgtgccgaacacgggcgtgaccgtccagcgcggccacacccacgacggcctgggcaagtactaccgcgagacgatcgaggagtccgcggacgccccggtcgacgtcgtccagatcctcaaggacaagcaggtcgacgttctcgtctgctacctgcccgtcggttccgaggtcgctgcgaagttctacgcgcagtgcgccatcgacgccaaggtcgcgttcgtcaacgctctcccggtgttcatcgccggcaccaaggagtgggcggacaagttcaccgaggccggtgtcccgatcgtcggcgacgacatcaagtcccaggtgggcgccaccatcacgcaccgggtgatggcgaagctcttcgaggaccgcggtgtcgtcctcgaccgcacgatgcagctgaacgtcggcggcaacatggacttcaagaacatgctcgagcgtgagcgtctggagtccaagaagatctcgaagacgcaggccgtcacctcgcagatccgtgaccgtgagctcggtgcggacaacgtccacatcggcccctcggactacgtggcctggctggacgaccgcaagtgggcgtacgtgcgcctcgagggccgcgcgttcggcgacgttccgctgaac

SEQ ID NO: 4153 - DNA, 1902 bp, Unknown
  Kingdom: Bacteria, Phylum: Actinobacteria, Class: Actinobacteria, Order: Streptomycetales, Family: Streptomycetaceae, Genus: Streptomyces
ctccgcgtacgactcggtgaggggtttcccctgctcccgggtgagcaggggagcgaggtccgccccggccgcctccacggcgtcggccgacgcgaacagggcggcggtgcgggcggcagggtcggcccgccagctcggccaggcctcgtgggcccggccgaccaccgcgtccagctccttcgcctgttggtcgggagcctcgtcgaaggcctcgcccgtcgccggatcgaggacggtgaagtgctcgccgcggggtgcgggaccgggtcggcgcagctgcggttccacgccggcggtcagctcgcggccggggtggccgcgtgctcccgggcgtgccggtccatctccgcccggaaggcggccaccagccggggccggatccgcccggtgttgcggtcgcccccctcgcagaccgccccgcgcacgcccacgatgtccgtcccgatgcgggtcagcgtggcgaggtccgccgtcttgacgctgcccgcgagggcggcgagcagaccggccccgtgggccagccgcacgaactccgcgcacgcctcgggcgacacatggtcgaacagccgggtcccgtccttgatcgcggtgtcgagcatggccgcgtcggagccggagcggtgggcgatgtcgggcagcgcgagcgggttgacgcagccgatccggtgggcgtcggcgtagcccgaggcgacgacgaacgcatcgggccggaagtccttcacggcgcggacgaccccccgcatgacgtcgatggcctggtcgggggtcgtgcacccgtagaggccgaccttgatgtaggtggctccggagacagccgcgccgagcgctgcctgggccaccgtgccgggcttgtacggcacgtctccgaccgtcgcggacaccggcttgtccgccgggaccgcttcgcggatctccctgatgacccaggggtagttcgcaccgagtgacccctcgtcgggcttcttgacgtcgacgatgtcgaggtgttccgcggccttcgcgcacgcgagagcttcctcgacaccgtccggggagatgagaagcagcaacgtggattccttccaccgcgtggtcacccgccgaacggcgagtgcgcggattcgacgggatcttgtgcggtcggctcatcctcgccgtgcgacggagccctcggcagggcgcgtgggatggcgaacggtgcactgctccgacgtactcacgccccctgcggcgcgccgttcacctcggcctccgccggatcacgtacgggccggctcctcgcacgacaggcgctggaccgccggaccgggccactgccgctgttccggggactgaccggaatgtctctgctggggcggaccccgcgaaccggaggccgtcgccgtcgccttcatcgggccggcgccgggtcacgcccccggcggcgtcagcccgtacgtgtccacggccgtgccgccgaacacggccgcctgctccgacgggctcagcgccgcggtcagcagccgggccgtcgcgaggacacggccgtaggaggccgcgagtgtgcagacgggccagtcggagccgaacatcagccggtacgggccgaacgcgtcgagcagcacgtcggcgtacgggcgcaggtcgtccacggtccaggtccgccagtcggcctcggtgaccaggcccgagagcttgcagacggtgttgggcagcgccgcgaaggcgcgcagcccggccgcccagggttcgagctcccccgaggcgacgggcggcttcgccgcgtggtcgaggacgaaggtcagctccggcagcgccgccgcggcggagaccgccgccggcaactggtgggggaggatcaccagttcgtggacgagaccggcgtcggccaccatcgcgaggccgcgcttcacatcgggacgcagcagccactcggggtccggc

SEQ ID NO: 4154 - DNA, 1620 bp, Unknown
  Kingdom: Bacteria, Phylum: Actinobacteria, Class: Actinobacteria, Order: Streptomycetales, Family: Streptomycetaceae, Genus: Streptomyces
gacggggccgcgtcggcggccgaggatcgggcagaggggaaaccggccgggtcgaaggcggcgccgaagccgggggcggcggccacgcacgtcatccgcacggccacgctctccgtcgaggtgaagagcgtgccgaaggccgtcgccgccgcgcgcggtgtcgcggagggcgcgggcggtctggtggcgacggagaacaccgagcggctcgacgacacctacgagacctctcacctggtgctgcgggtgccgcaggaccggttccaggaggtcctgcgggacctggccggttccgggaagctgctgtcgcgcacctcgaacgcgaaggacgtcaccgaccaggtggtcgacgtggacagccggatcgccacgcagcgtgcgagcgtggcgcgggtgcgggagctgatggacagggcggagaagatcagcgatgtggtcaccctggagggcgagctgagcagccgtcagtccgacctggagtcgctgctcgcccagcagtcgagcctgaaggaccgcacctcgctggcgacgatcaccctggacctgacgccaccggacgccccggacgacgacgggcgggaggaggacgccgggttcctggacgcgttgggcggcggctgggacgcgttcgtgacgatgctgcggtggatcgcggtggcgttcggggccgcgttcccgttcctgctcaccggggtgctggcactgttcgtgtggcgggcggtgcgccgtcgttgggcggcccgtgcggcgaccccggcgggcacgccggagcaggaggggacaccggcgccctgaagcgctccagcgccgtagcgtggggacctgactcgccggatcggcgactcgcgaaaggggacccggcatggcagcggagcgactggtggtcatcggcggtgacgcggcgggcatgtccgccgcgtcacaggcccgcaggctgaaggggccggacgcgctggagatcgtcgccttcgagcgcggccacttcacctcgtactccgcctgcggcatcccgtactgggtgagcggcgacgtcgaggcccgcgacgacctgatcgcccggacccccgaggagcaccggcagcgggacatcgatctgcggatgcggaccgaggtgacagaactcgacgttcccgggcggcgggtgaaggcgctggaccgggagagcgggaagatgtactggacgggcttcgacaagctggtgatcgccaccggggcccgtccggtgcgcccggcgctgcccggcatggacgcgccgggggtgcacggggtgcagaccctggacgacgggcaggcgctcctggactcgctggacgccgtgggttccgacggagggcgccgcgcggtcgtggtgggcgcgggctacatcggcgtcgagatggccgaggcgatgctcaagcggggcttcgaggtgaccgtcctcaaccgtggcgagcagccgatggcgaccctcgacccggacatggggcggctcgtccacgaggcgatggacgggctgggcatcaccacggtcaacggggccgccgtcaccaggatcctcaccggtccggacggccgggtgagcggggtggcgacggacgcggggacgtacccggcggacgtggtggtcctcggcatcggcgt

SEQ ID NO: 4155 - DNA, 2069 bp, Unknown
  Kingdom: Bacteria, Phylum: Actinobacteria, Class: Actinobacteria, Order: Streptomycetales, Family: Streptomycetaceae, Genus: Streptomyces
cgccgagctcggcgtcgagccgttcgcgggcggtcatctcccgcagcccggacggcccggcggcgtggaggccggcggcgagcgggatctggccgggcccggggcgggtgcgggcctggcggtggagctcggtcgcctgcagcagcaagtcccgccgcgtcgaggagccgttgagcgggtcgagggcgccgatgctgatgaggcgctcgacggtcgggagcttggggtgggcgcgggcgtagaaatcctgcagggaggtgtagggctggccctcggtgatccgggtgacctcgtcgtcggagataccgtgcaccgtggacagggagatccgcacgccccacccggagccggtctcctcgacggtgtactgcgccttcgaggcgttgatgtcgacgggcaggacggggacgtcgtggcggcgggcgtcggcgacgatgacccgggccggccacatccccgggtcgtgttccagcagtcccgcgtagagagcggccgggtggtgggccttgagccaggcggactgcagcgcgggcacggcgaacgccacggcgtgcgcccggcagaacccgtacgcgccgaacgaggcgacgatgtcccagacgtcgtccagcaccttcgggctgtagccccgggctccggcctgctgccggaaccacgcctcgatcttcggcagccgttgctcgtcgctgagggcgcggcgggcgacttcggccagggcgcggtcgcagccggtcatgaccgcgaggatgtcgatgatctgctcgtgccagatcgtcaccccgtacgtgtcgcgcaggaccggctccagatcggggtgcgggtatgcgggtgcggcgccgtggcgggcggcgatgtagagggcgggcatgccgccctggaccgggcccgggcggaacaggctgatgtcggcgatgacgtcctgcgggtcacggggctggaggcggccgaccaggtcctgctggccgggtgactccagctggaacatgccgacggtgtcggagttctggatgagtgcgaaggcgaaccggtcgtccagcgggacgtggtcggggttgtcgaggtcgatcgcccggccggtcgtacggcggatctcggtgaccgcgtgcgccatggcggactgcatccgcaccccgaggacgtcgagcttgagaaggcccaggtcctcgacgtcctccttgtcggcctggaccatcgggtactcgccgccgggggtgggctggaccggcagccggtccaggagggtcgtgttggagaggatcactccgcacgggtgcatcgcgatcccgcgcggcagcgcgtccagcccttcggcgagctcccagagcggcccgaaccgcccggcctcggcagccagctcccggagttcggggagttcggtgagtgcggagcggatgtcgccggcccggatgtgggggaaggacttcgcgatccggtccacggtggcgggcgcgatcccgagcgcgaggccggtgtcccgcagggcgtgccgggcgcggtaggtctcgggcatgccggtgaccgcgacccgctcccgcccgaaacggtcgatgatccggtcgtagacctccagacggcgcgcggactcgacgtcgatgtcgatgtccggcagcacggagcgccgctcggacaggaaccgttcgaagagcaggtggtgttccagcgggttcgcggtggcgacgaagaggctgtggttgaccatggagccggctccggagccgcgggcggcgacccggatgcccatgtcccgcacgtcggcgacgacctgggccacggcgaggaagtacggctcgtagtgcaggcggccgatggtcccgagctcgtagtcgagctggtccatggcccgccggtcacggtcgagaccgcgggcactcatgccgctctcgcaccgttgccgcagcagccgcatcgccccgtccggacccggtgcggcgccgaccacggacggctcggggaaatgcggtaccccgagaccgaggtcccggaccgggtcgacctcgcacgcgtccgcgacggcgatcgtgtcggcgatcagcttcacggcgcgagacgggtcggccccggcggcggcc

SEQ ID NO: 4156 - DNA, 603 bp, Unknown
  Kingdom: Bacteria, Phylum: Actinobacteria, Class: Actinobacteria, Order: Streptomycetales, Family: Streptomycetaceae, Genus: Streptomyces
  misc_feature (313)..(470): n is a, c, g, or t
ccagcagccggtccgcgaccagccgcaccccggagccctcctggccgacgcccacccgcttgccccgcaggtcggcgaccgtccggacgtcggagtcgcgggggacgaccagctggacgtagtcgtcgtacagccggacgcagccgcgcagccgctgggctcccggcctgccgtcgcgcagataggtggccacggcgtcggcggtggcgatggtgaagtccgcctcgcccgtcgccacccgggcgaggttctgctgcgacccctcgctggtccgcagccgtatggacacctcgggcatgtccttggcgagcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcagcccgagcacgaccgcgaggacggcgcccgtctgcagggtgcgtcggcggccgaatcgggacagagcgtggaacatgcgcgcgatcctgccagctcacccgcccccctgaccaggcttccccgtgaggcc

SEQ ID NO: 4157 - DNA, 1104 bp, Unknown
  Kingdom: Bacteria, Phylum: Actinobacteria, Class: Actinobacteria, Order: Streptomycetales, Family: Streptomycetaceae, Genus: Streptomyces
ggccgggggcgcccccggccgcgtaccaccgctcctcgatctcccgggcgtcccggccgtcctgtgccgcctgccgcagctcgtggccgaccaggtcctccggctgcgcccaggtgaggcggacgttcaccgctcaccggccagcgcgtcgaacgcctgctcatgggcccggcggcgctccaggtcccgggcgaagacctcccgggccacctgtgccagcacccccgccgggccgtccaggtccagtcggctcgcctccgcgaccgcggcggcccagtcggcggggatctcgccgcccagcgcgcccacgatcgccccgctcatcgtcgcgatggagtcgcagtcccgcccgtagttcaccgaaccgagcaccgtacgccggtagtcgccgccgccgaccaacaacaggcccagggcgatgggtagttcctcgatggcgtgcagccgggacgggcggcgcgcgccgagcgaggggctccggtagtcgggtcccaccgtgtcgaagggttccaccgctgcccgcagcggtgcgagcgcggactcgaagtcgtcgtgccgcgcggcgacttcgcagaccgcctcgatcgcggaccgggtgccgtccttcgccagggcgaggacggcgtcgatcaccgcgccgggagtggcggccgggcggcaggcggcggcgacggcggccgcgaagaccccggcggcctcccgtccgtaggaggactggtgcggagccgcgacctccagcgcctccgcgtacgcggcttccgggtggccggcgttgaccaggccgaccggggccatgtacatcgccgccccgcagttgacgatgttgcccgcaccggcctcgcgcgggtccacgtgcccgtagtgcagccgggccacgatccacttctccgccaggaagatccgctggaggggaagggcctccgcctccagctccgggatccagcggggtgacagcaggtcagggacgaggtggtcagcgacggcgtaggcgtcgaggtggtcgcggacccggtcgtagacccggatcagcgcatgggtcatcagggtgtcgtcggtgacgtgcccgtcgcccttgtggtacggcgcgacgggcacgtcaccgac

SEQ ID NO: 4158 - DNA, 1019 bp, Unknown
  Kingdom: Bacteria, Phylum: Actinobacteria, Class: Actinobacteria, Order: Streptomycetales, Family: Streptomycetaceae, Genus: Streptomyces
gctggaccgccccgcgttcaccgcattcttcgccaccggtccggaggcccgcccgttctcgctgcgggcgctcggccaacacccgctgcgggtccgcgtcgacctgccggagcgcggccacgcggaggcgtcccggctgctcacccggctgctcctggcccagttcaccgcgatcaccgcggcccgcaccgacaccacgctcttcgcctgcctcgtcctggacgacgccacccacgccgtgaccgcggagaccgtgcggggcatccgcaagctgcgctcggtcaacgcgggggccgtgctcgctctgcggaccgtcgacgacgttcccgagaccctgcacactccgctgctcggtgcggtcggctgcacggccgccttctccggcatcaccacctgggacggcaaacgcttcgccgaagcctggggcaaggaatgggtcgagacccgcgaggtcgcccagcacaccgtcttcgccgaccagccgttcacccgcgccctgcacgccctgcgcaaactcgtcaccggcaaggccgtgaccacggacgcggtgaccgtgcggcaggtcgagcgggagcgctggtcggcctcggagctggcgtacgcggtcccggccgggcatgccgtcctttccctcaccaccgtccagggggagcacgcaccccccctcctcgtccacctcgacggctgaggcacctaccgataagtagggcgaagggcggctgagagcggttaccggcactctgccgccctggcagaatcggaggcagccgttcatacgcgacggcgaaattcggtgtcaccgatccggtcggcgatccagtcgtccgcacggcggcgccgcgacctcgtccccgaccttgagggttcccggctcatgccccccacgctcgcctcgctcgtccagcactcggcgctcaagctcaccgtgcgggcgggcgcggaccggctcggcacccccgtgcgctgggcccacgccagcgagctggccgaccccgtcccgtacatggacggcggagaac

SEQ ID NO: 4159 - DNA, 1529 bp, Unknown
  Kingdom: Bacteria, Phylum: Actinobacteria, Class: Actinobacteria, Order: Streptomycetales, Family: Streptomycetaceae, Genus: Streptomyces
acgcccacaccgcggccctcgccggacccgccccctccgggcagctggtcggcgcccactgacggccccggtccgcgtgccgtcgaggcgcgcggaccgggtgccatgacccttctccgccgggaccgttgcgttctggggatggccccttcatctgccgtccacccaactcggcccggaatgtgggtttccgcgagcacgctgcgcaggtgagacgcatcgtgggaatcgtcctggcggtcgcgctgatcgccggtgtggcagcggccctcgccctgggccgcgacagcggggacagcggcacggccggaaagaccgtgcgcggagtgatcgggtcggagaaggccgagttcttcgccgaccccggcaccgtgaaggccctcgcggccaaggggttcaccgtccggacggagacctccgggtcctgggcgatggaccgactccccctgaaggggtacgacttcaccttccccggctccaaggccccggccgatgagctgcgccgggggtccgaggcccagggcggcccgctgcggccgttctactcgccgctcgtcgtggtcgcccatcgcaacgctgccgaggtcctcgcggacaacgggctggcccggctgcgggccgacggcggatcgaagttcaccacgcaggggacgctgctcatgggcccctacctggcggcggccgaggacgaccggacctggcagcagctcaagggggcttccgggcactccgagttgagcggcacggtgttcatcacgagcaccgaccccgtcacctccaactccggcgcgctctacctcgccgccgcctcgtacgtcgccgacggcggccgggtcgccacggacgcgaaggccgtggaacgcaccgcacccctgatgcgcaagctcgtccaggtgcagggcgcgcagcagacgagcagcgacgcgccgttccgcgacttcatcagcggagtgggcaaccccctcgtgctggtctacgagtcgcaggtggcctccctcctgatgagcagtcaacggcaggagatcggcgacctcgtcgtcctctacccggacaccacggtgtccagcgaccacaccctcgtaccgctgaccgacgacggccgcgaactcggcgagctgctgtccaccgaccccgcgctgcgggagctggcggtacggcacggcttccggccccagggcgcggcggccgagttcgtcgccgcgaccgcggaccacaccgcctacatcgaccagcggctgaccggcgtacgccaggcgcccgtgcccaccgcggaggtgctgcgctcgatggcacggcgggcccgcggctgacgacgcccccgcccgcactcagccctgttcccgcggcaccggccgccgggcctgttcccggctccggaccgcactcgcagcacaggagaccgccaccatgccccaggacgccggagcccggaacgccgggcctcaggacgccggatcccagcacgccggacccccggaccctcgactgccgttcgacccgccgaccaccccgctcgtgctcaccccgcc

SEQ ID NO: 4160 - DNA, 611 bp, Unknown
  Kingdom: Bacteria, Phylum: Actinobacteria, Class: Actinobacteria, Order: Streptomycetales, Family: Streptomycetaceae, Genus: Streptomyces
ccgtccagtcgcccacgccgaacacctcacggacagcgcggccgcgccgtccgtgagtgcggcgagggcgactggacggacacgctgggactgctgcggaaggcggggccacaagggctgatcgaccgggtgcgggagctggaggacgccgacgcggaggccgggcgcgtacggctgcggcgcggcaagacgcacgacgacgccaccgcgctcctggtggaactggactgagcgcgacgacgacggaacggctcgcgtcgcgcgacacctcctccgtacggctcgcggcgaccgcgacggccccggtgctcagctttcggcgcgggcgttcaactggtgcaggagcctggccagctcggccacctcggcccggtcccagtcggccagcttgcgcacgtagcgtccccggcgggcgtcccggacgctgcggaagcgggccagtccgtcgtcggtgagatggacgagccaggcccgcccgtcggccgggtcgggttcgcgggccaccagtccgaggttctccagggagcgcagctggcggctcatggtggccttgccgacgccgaagtaggcggccagctcggtggcccgctgccggcccgccgcctccaggc

SEQ ID NO: 4161 - DNA, 1046 bp, Unknown
  Kingdom: Bacteria, Phylum: Actinobacteria, Class: Actinobacteria, Order: Streptomycetales, Family: Streptomycetaceae, Genus: Streptomyces
cgccaccgcgaccgccgagcggttcggccggctcgacgtgctcgtgaacaacgccggcggctccccggaagccgacgcggcgaccgtctctccacgcttcgtcgagaaggtggtcgcgctcaacctcctcgcacccttctacacggcccaggcggcgaacctggtgatgcgggagcagccggacggcgggagcgtgatcaatatcggcagcgtctccgcccacgacccgcagccgggcaccgccgcctacaccgcggccaaggcgggcctgctcggactgacccgggcgctggccatcgaatgggcgccgcgggtccgggtcaaccacatcaccgcgggcctcatccgcaccgagaacgccaccgcgctgtacggcgacgacggcggggccgcggtggcggacatcgtcccgatgggacgactggcggaaccggacgatgtggcgcgggcctgcctctggctggcctgcgacctctcctcgtacgtcaacggcgccgacctcgccgtccacgggggcggcgagatcccggccaggcaggtggtccgacggccccacccccccttttcgtcaccttgactcttttcacccccacccattatcgtcgcaatgacgaaatcaagggggacctgatcatggccgacatcacccggcgcttcggctggcgccacctgcgctccgcgcccaccgcccacatccgccaccacaaccgcggccgcctcacccacgacggtcaggggctcagcttctggtaccggtcgctgtcggcggcgctctccgaagtgccggtcgacgaccgggagctggccatggcgttccacgcccgtacggccgacttccaggacgtcaccgtgcaggccacggtcacgtaccggatcagcgatccggccgaggcggcgaaccgactcgacttctccgtggacccggacaccgggagctggcgcggcgcaccgctcgaacagatcgccaccctcctcaccgagaccgcgcagcagcacacgctggacgtgctggcccgcaccccgctcgcggcggccctggtcgacgg

SEQ ID NO: 4162 - DNA, 822 bp, Unknown
  Kingdom: Bacteria, Phylum: Actinobacteria, Class: Actinobacteria, Order: Streptomycetales, Family: Streptomycetaceae, Genus: Streptomyces
cccgtctcttttccttgaattgccgggctttctccgcacccccctcccctgaattcaccattcaattgaaaacgcgatttcctcggatgccccacgtcgatttgcggcggcctcattcctccttttcactcattacgtccaccccatttcccacaggacggggaacaacccatgttcaccacggacaccactgccaccgacatcgagctcgacctcgacgcggccctcaacccgggcgaggtcgaaggtctgtaccgcgactcccgcgagtgcgcctatctcgcgcttctcgcgggcggcggcgcgctgctgctctcgcccccgaccccgcgcccgaagaagggctagtcgccggcacatggaccagacacatgcttcgtcgcccctggcgggtgccgtgcatgacctggcaacagaggtggtcctcgctcttcggagcggggaccacctcgccacggtgtgcggcgcggcgggaatcgacgaggagaatcggaccggaatcgcggcggcacgggtcatcggggccgacctgctgctgcccagtgttctgtacggtcgtcatccgcatccgggcgacgtcgccgtactccaccgggcggtgcgggagttcccgcccaagcccgacgctccggccgccacggcctggagccactggcacatgatctccacgcttcagcgggtgacgccgcctcccccgggagcggctgctcccgcgacgtacgcggagcccgacgcggcctggctggaggaggccccctggcaggcgttcacccaccagctctcggtgctcgcgccgctggccgtcccggcggctccctcggc

SEQ ID NO: 4163 - DNA, 816 bp, Unknown
  Kingdom: Bacteria, Phylum: Actinobacteria, Class: Actinobacteria, Order: Streptomycetales, Family: Streptomycetaceae, Genus: Streptomyces
gcacgacggagaagagcgcatgaccggcaccaccaccggcgaggggacccccaccgcctccgcccgcacggcctccgcggcgcgcaccgtcaccgacgtcctccagccgcgcaacgtcctgctggcgggcatgctcggcctcggcctggcggcggcgggcgactggacgggactgctctggggcttcctcggggcgctctgcgccgggctgataccggcgggatacatcgagtgggagcgcgggcgcggcacctggggcgaccgtcatgtggtggaccgcaccaagcgggcgccgatcttcttcgtgatcctgggttcgatcggcgccggctcggtggtgatggtgctggggaacgcgccggccggcatcctcgtcgcgatgctcgcgctgtgggtgatgacgatcggactgctggccgtcaacacggtgtggaagatctcggtcgactcggcggtggcctcggcgtccgtctccctcctcgccgtcgtgcactccccgtggtggatcgccgcgtacgcgctgacctgggcggtctgctggtcccgggtcgccctcggctaccacaccgtcgcccagaccgtggcgggcgcgggcctgggcgcggcgacgacggtggcgtacgtgttcggctgagagccggtcgggttactaccgggtcggcgttgtcgggtcagagcgcggcgcactgcccggtgcgcggtccactcacctcgttggcgcggcccgtgtcgtccacgcccggccggttggcggagcacaccagcgggccggtgaccgtgttggcggcgagcagcacgccgccaacacggtcaccg

SEQ ID NO: 4164 - DNA, 1273 bp, Unknown
  Kingdom: Bacteria, Phylum: Actinobacteria, Class: Actinobacteria, Order: Streptomycetales, Family: Streptomycetaceae, Genus: Streptomyces
ggacgtggtcttccgcctcgccggcgacggcaccctggactaccgctcgaaggaacgcgccgcgggtctcccgtacgggaagctcaccaggtccggcggctgacggcgctgggggctggcgtacgctggatcggtccgaggatccgtagaaaaaccgccgaaaggtgacagcccggtgaccgagaaggccgaccttcagcccgtcctcgaccgagccgccgaaggcggtcggatcaccccggaggaggcgctcgacctctaccggtccgcgcccctgcacgcgctgggcgccgccgccgacgccgcacgccgccgccgctacgccggtacggaacacatcgcgacgtacatcatcgagcgcaacatcaactacaccaacgtgtgcgtgacggcctgcaagttctgcgccttctacgctccgcccaaggacaccgccaagggctggacccgcgacctcgacgacatcctgcgccgctgcgcggagaccgtggagctgggcggcacccagatcatgttccagggcggccaccacccggacttcggcgtggagtactacgaggagcacttctccgcgatcaagaaggcgtacccgcagctggtcatccactcgctgggcgcctccgagatcgagcacatggcccggatctcgaaggtctccgccgaggaggccatcagccggatccacgccgccgggctcgactccttcgccggcgccggcgccgagctgctgcccgcccggccgcgcaccgccatcgccccgctcaaggagtccggcgagcggtggctggagatcatggagatcgcgcacggcctcggcgtcgagtccacctccaccatgctgatgggtaccggcgagaccaacgccgagcgcatcgagcacctgaggatgatccgggaggtccaggaccgtacgggcggcttccgcgccttcatcccgtacacctaccagccggagaacaacaagctgaagggccagacgcaggccacgctcttcgagtacctgcggatgatcgccatcgcccggctcttcctcgacaacgtcgcccacatccagggctcctggctgaccaccggcaaggaggtcggccagctgtcgctgcactacggcgcggacgacctcggctcgatcatgctggaggagaacgtcgtctcctcggccggcgccaagcaccggtccaaccggctggagatcatcgacctgatccgcaaggcggaccgggtccccgcccagcgcgccacgacgtacgaacacctcgtcgtgcacgacgacccg

SEQ ID NO: 4165 - DNA, 957 bp, Unknown
  Kingdom: Bacteria, Phylum: Actinobacteria, Class: Actinobacteria, Order: Streptomycetales, Family: Streptomycetaceae, Genus: Streptomyces
cccagcgccccgcaaccccgctcccgagcacgagcactcccccgtcgacctcccacatccgcaccccgtcccggcgtcggcgggcactcatcacccgtgggtgcacggggtcggtgacctcccgcagctccagccccggctcgccgggcaacgaggacgccacggtcaggaggtcgatcgtgtcggtgacccgcccggtgcgttcgaggaaggccgtcaggaagcgagggtgcatcgtggcggccagcgcatcgcattccagagcggccagcgtcgcgtggacccattcggggtcctcatcggtgaacacgaccgagtgcgcggtgaaagcgatcacccccgtgtcgcgaccgctcggcgcggcgaccacggtggtccccccgtcggtctccggaaaccgcccgcacgccgcctcgtccaggatctccgccagcgtctgccccatgaagtgcccccgtgtccctcgtcgttcagtcaggccgtcgtaccaccgcagcactgcgtcaccgcgcacgggtgatggacgacgaaacgcccatccgcccctctcgcagcgcaccggctcagactagggcggtccatcgcgcggcaggcgcaccggtacacgcaccggaagaaagcgtcctcgacgcagccgactcctcatcaccccccctcattacctccggcgtaatcgaccgcgtccgcccttcccggcaggatcgaacccatcaacgggaagccctgacaggccacgccccagcagcgaggagagcgccatgtccgtcacgccccccaccctcacggcaggctcggccgacgccacgccttcccccgccgatgcgacccgggccgtagtccaggagttcctcgccgcccggctggccggggacaccgcgcggctcacggcgctcttcgccgacgaggtcgactggctgctggccgagaacccggccgtgccgtggatccgcccccggt

SEQ ID NO: 4166 - DNA, 2076 bp, Unknown
  Kingdom: Bacteria, Phylum: Actinobacteria, Class: Actinobacteria, Order: Streptomycetales, Family: Streptomycetaceae, Genus: Streptomyces
cgccgtgctccggccggcgtgaccaccgcgtccacggggtggtcgtgcggttccgaggggacccgcgcgaccacctcgtcgtcgtacagcagcacgaccagcggggggtgcgccccggcggccgtcagccgggccagcacccggtcgtagctgccgcctccccgccccagccgcatcccggccccgtccaccgcgaggccgggcagcagcaccgtatcggcgtcgaggacggcggcggggcccaggcgcgggccgtccggctcaaggagtccccgcccggccgggaccaggtgctccgggcccgcgtaggccgcccagtccaggtcgttgtcggccaggaggaccggcagtagcacccgcgcaccgcgcccgcgcagcgcttccaggagggcgcgggttcccggttcgcgccccacggagacgtacgcggcgaccgtacgggcgtcggccagttcggacaggcgcagggcagtctcggccagaaccgcggcgctccgggcgacgtcctccttcgtcaggagggcccgcgcggcgagcagttcgcgccgcagggagctcttcgcggacgcctttccggacttgtcggtgttcaatggtgactcgcacgattctcgtatgggcatatttaaggacgaagttaaccggaatatcagcttccggccgtgtgcagccgttaaggtctgcacatgactcagtcgccccccaggatcagcaaggccgtcattccggcagcaggtctcggcacccggttcctgcccgccacgaaggccactcccaaagagatgctgcctgtcgtcgacaagccggccattcagtatgtcgtcgaagaagccgtggcagcgggtctctccgacgtgctgatgatcaccggccgcaacaagcgtccccttgaggaccacttcgaccgcaactacgagctggagtccgcgctcacccgcaagggcgacgccgaacgcctcgccaaggtccaggagtccagcgacctggccaccatgcactacgtacgccagggcgacccccgcggcctcgggcacgccgtgctgtgcgccgccccgcacgtgggcgaccagcccttcgcggtgctgctcggcgacgacctgatcgacccgcgcgacgcgctgctggcccggatggtcgaggtccaggagcgtgagggcggcagcgtcatcgcgctgatggaggtcgacccctcgcaggtccacctctacggctgcgccgccgcggacgccaccgtcgacggcgacgtggtccgcatcaccgacctggtcgagaagccggacccggccgacgcccccagcaacctcgccatcatcggccggtacgtcctggaccccgctgtcttcgaaatactgcgacacaccgagccgggccgcggcggcgagatccagctcaccgacgcgctccagctgctcgccgcggacgagaagatcggcggccccgtgcacggcgtcgtcttcaagggccgccgctatgacaccggcgaccgcagcgactatctgcgcgccattgtcagactggcgtgcgaacgtgaagacctggggccggacttccggacctggctgcgcaagtacgtcgctgaggagatgtaaccccgtgagccgcacgatctggtcggtggacgagcacctggacgacatcctcgcctcggtgaggccgctggagcccatcgagctgcagctgccggacgcccagggctgcgttctcgtcaaggacgtcgtcgttgaggtggccctgccgccgttcgacaacagctccatggacggttacgcggtccggatcgccgatgtcgagggcgccagcgaggagttccccgcggtcctcaccgtcatcggcgacgtcgccgcgggcagtgcggggctcgccgacgaccaggtcgtgggaccgggacaggccgcccgcatcatgacgggcgcgccgctgcccgcaggcgcggaggccgtggtcccggtcgagtggaccgacggcggcacgggcgagggcccggccgccgccatgcgtgcccacagcgatgcgcccgaggacgccaccggcgaggtcagggtgcaccgacccgtcgtggccggcgcgcatgtgcgc

SEQ ID NO: 4167 - DNA, 2581 bp, Unknown
  Kingdom: Bacteria, Phylum: Actinobacteria, Class: Actinobacteria, Order: Streptomycetales, Family: Streptomycetaceae, Genus: Streptomyces
ctgcggggcggggagccaggtggccccgggcgggaggaagtccgtcacgtcggccggcccggcgacctcgtcgctgtcgaccgcgcgcagccggtgccggttcgggtgggaagggagggagcgggcggtgggacgggccgcagcgggcgccggggacgccgcggtggcggcggacgcggcggagaaagtacgagtgttcgccatgagggtcagctctttcgcgcgaggagtcgtcagggacggacttacgtcgtacgcgcggaccgaaggccggggtgagcggctttagtgggcctgcgcgttccacgcgcggcaacacacccggtcgaaatcatggtgctgacgggaaggccagaacggttcgaggtcactgcgacccgacgcgatgtgctggtagctggccatgtgctccattgaagcagatatcgcggcggtgcatcagcctcctctcgcccgtcgatacggaccctcggcgttacgttcctcacgcccggccgtcaccgcccacgcgggaggggtccgccggcgaaccggcggacccctcccgcatgactggcggcgcgatcagacctggccggccttctccagcgcggtgcagcaggtgtcgacgatgagccgtgtgacgacgtacgggtcgacgttggcgttgggtcggcggtcctcgatgtaacccttccggtcctgctcgacctgccacgggatacggaccgaggcgccgcggttggagacgccgtagctgtactcgttccacggggcggtctcgtgcaggccggtgagccggtcgtcgatgcccgcgccgtagttcttcacgtggtccatcggcttggatccctcgcccagcgactcgcacgcggtgatgatcgcgtcgtagccctcgcgcatcgcccgggtcgagaagttggtgtgcgcgcccgcaccgttccagtcgcccttgaccggcttcgggtccagggtggcggagacgttgaagtcctcggcggtgcggtagagcagccaacgggccacccacagctggtcggagacctccagcggggacagcgggcccacctggaactcccactggccgggcatgacctcggcgttgatgccggagatgccgagccccgccgccaggcagttgtcgaggtgcttctccacgatgtcgcggccgaagatctcgtccgcgccgacaccgcagtagtagccgccctgcgcggccgggaagccgccctcggggaagccgagcggccggtggccgtcgaagaaggtgtactcctgctcgatgccgaagatcggtgcctggcccgcgaactgctcggcgaacggacgcagcgcggcacgggtgttggactcgtgcggcgtcatgtcgatgttgaagacctcgcacaggacgaggatgtccgcgccgccgcggatcgggtccggacaggtgaagaccggcttcagcacccggtcggacgcgtggccctcggcctggttggtgctggagccgtcgaatccccagatgggcagatccgccacgtcccccgacggagcgccgtccatgatcttcgtcttggaacgaagcttggcggtcggctcggtgccgtctatccagatgtactcagccttgaacgtcacggacgccatcctttgcgggtgcagcggtctatgcggcgcagcttggcaagacgcgatttcccgtccgttgcccggatgtgaaccccgtgttaccgaggtttcctgcgttaccggaaggccgcgtccggacccctctcccgttgcccggaggattcggggagatcctcagacaccgcccttgagcagggccgagaacccggcggcccgcagccggcggatcagttcctccctgctcgaccccagcgcggcggccgcccggtccagctcccagtcggccccggccagggtccgcaggagatgtccccggcggatctgggggtcggagagccggaacgtcttgaggtaggcgacctgcccccggtgatcggtgatcgtctccccgatgtgctgcccgcccccgtcccggacgaacggcggcaggaagcgccacagggtgaaggacttcatccggtacacccggtcgaacgcgtacgaggtgtccagcagctcccgcgcgaacagggtgtcgtgcgcctcctcccacgcccgctcccgcacccgcgccgccgaccgcagttcgccgaggtcacggatgtgctcctcgcccccgatccgcaccggcatccggggcaccggcgccccgtacagcgcgtactggtgcaccagctccccgtagaggtcctccaccagcgtggcgtgcagcagccggtagtcgtccgggtgcgggacgacgaaggcggcggcgagcgcgtcggagacgtacaccatcaccccgcactggcccgggtggatctcgaagatccgcagcgcgtccgcgagcccgcgcacggacctcccgagataggcgtcctcggcgcgcggcgagagcccgtcgcgcagggccgtgcgcgaccactcctcccaggcggtcgacggaccgccgaagtgcagcgcgagatatccctccagcgccaggtgcaacggcaggaaccgcagccggtcgccgggccgcgggcccactatg

SEQ ID NO: 4168 - DNA, 1269 bp, Unknown
  Kingdom: Bacteria, Phylum: Actinobacteria, Class: Actinobacteria, Order: Streptomycetales, Family: Streptomycetaceae, Genus: Streptomyces
gtggaaccggtggagccggagcctccggtggacgaggagccgcccgtaccgccggtggaaccggtggagccggaggtgtccgagcccttgccggtgtcgatcatgatctgcgcggtgtcgttggccgcgttccggtcgaaggggcgctcctggccgctgaacgagacctcgccggtggtgcggccgacggccttgtcgatgcgcaggacgaaggggtagctctcgccgccgtccacatccacccaggactgcgaggtaccgcagcggtagtgcgtcttggtgaccgcgtcgcagtacccgtgcgccttgacgacggacgtgcccttcgggatgcggacgtcgacggtggtcacgctccggtcgatctctccctgcacccgggcggggcccttgttggcgaacttcaccgtcgcggtgaccttgtcgccggcctcgcccttcagctcggcgccggtcaggccgaagtctgcggtgttcgccgcggtgacgtcggccgaggcggccggttcggggtggttcttccggtcggcgtcggtggccgggcccttctcgaccagcgtgagcgggtcgccggtgccctgtaccgggtcggtggagccgctgtcgccctcgtccgggtccggctcgacgacgccgatcgtcacccgcaggtcgtcgttgagcgcggagtcgagcgccttgagggagagcggcttctgcgtcccgtagacgacgcccggcttcagcggctggtcgatcttgcaggcggcgacgtgcgagtcgggcatctcgtcgtaggacgggatcgtgtagtagctgcagttcttgtacgtctcgtccgccttcagaccgggcgacacggcatacgtcacgtaggagacgggtacctcctccgtccccttgttgaggaaggtcaggggggtggagaacgcgcttccggcctgaacccccgtgaccggcgcgatcgttccgacgccgaggtccggttccgcctcggcggcgaacgccggcacggcgcccagcgccaccaacgctgcggcggctacggcggcggtcccgccgcgcagggtacggctgcgggaaggggggatgcgcatggaagtccttcggtcgtgggggctcacgggctgactgcggtccttcacccctcaagaccggtgccggagagggacggttgtgccgacctgagcggtcgtgacagaacacggacacaaggcaccagtaccggacacggacacggacacggaccgaggacacccgtaccgggggatacgggtgtcctcggtccgt

SEQ ID NO: 4169 - DNA, 1958 bp, Unknown
  Kingdom: Bacteria, Phylum: Actinobacteria, Class: Actinobacteria, Order: Streptomycetales, Family: Streptomycetaceae, Genus: Streptomyces
gccgtgaacgcaccgcgttcaccccgggccagcgtccgcagcaccggccgcaggaacggcccgagctccaggacccccgcccgcagggcggtcagcggatcgtggctgccctcaccccattcctccggccgcacttcgccctgctccaggcgggccaccagccgggccaccggccatcgcggccgtgccgccagccgggccgcgcagaaccgcagcgccagggggttcccgtcgcacagctccaacaaccgcgccacgggacctggttcggccccgaggcgggcgcccccgatggcggccacgaccagctcacgcgcctcggccgcctccagccgacccacccggaccccccgtacgccctccagcgaggcgagcggccggcggccggtgatcagcgtccggcacccgggtccgctcgccagtaacggccgcacctgccgggcgtccaccacgttgtccagcaccacgaggacccggcgtcgggacaacgcgctgcggtagagctggagccgttcgtccaacgtttcgggaaggtccgcgccacgttcgggaatcagcgcccgcagaaagcagccgaggacctccagcgggctcttcgccccgccgccctcacggcgcaggtcgatgtagagctggccctgccagaagtcgtcccggcagatgtgtccggcgcgcacggccagtgccgtcttgcccgcaccggcctcgccggtcaggacgacggcccggtagccgctgcggctccctctcaacacctccagcacgtcggcgagttcggatcgacgtccgacgaagcccaccgggtccatcggcagcatggcgggcaccaggccgagccacgggctgtgcggcccgcgatgccgctggtgggttgcggcgccccggtccggcgcgccttccggtgcggcgtcgggacaggtcccggtcgccaccggagccagggcctcgaccgcggccggtccgggcaactcctccagcagtacggcacggtgcagcgcccgcagcgccgtgcccggcaccacccccagctcctcctggagaacccgccgtccctgctcgtacacgcgcagcgcgtccatctgccgatcactgcggtacagggccaccatcaggtggccgcgcagcgactcccgggtgggatgctcggccaccagtctgctcagctcaggcagggcggcgacatggcgccccagggcgagtacggccgccatgcggttctcgatcgcgccgagccgagcctcctccagcgcgggcagctcggtccggctcaggaactcggtgacgtccgacagggccggcccccgccacagcttcagcgccgactccaggctggccgcggcctccgcgtaccggtgcttcaccagatccctgcgcccctgctccgccagttgctggaacgccgcccagtcgaaccacgcggtgcccagcaccaggtggtagccgcggtgtctgcgcaccacccggagtcccggaccgcagcagcgcctcagccgggagatgtaggtgtagagctgggcagtcctggtcgcgggcgggctcgccccccagagcagttcggcgagccagacgtccgagacgaaccgtcccggggagatgaggagcgccgcgagcaccgtgcgctgcttggccgcggtcagcgggatgcgcacaccctgaacccagacctcggtggcgccgagaattctgaactccgtgcgggctgaggcgtggtgcgggggcatcatgcgcgccccccacccggtcgggaacaggtcattcgtcgcaggcttcgcccaggcgcagtgccgtgtcgatcatcatggcggtgaactcccgtacgcagggcccggtccgcgggccggacagcgagagcgccgcgacgacccggccgccggggccgcgtacgggaacggccagggtcgccccgtcgccggtgggcccggcggaaccctgcgcccagccccggtggcgcacctggg

SEQ ID NO: 4170 - DNA, 1893 bp, Unknown
  Kingdom: Bacteria, Phylum: Actinobacteria, Class: Actinobacteria, Order: Streptomycetales, Family: Streptomycetaceae, Genus: Streptomyces
gggtggtggcggcgggccgggctccggtgccgccggccggcgggggaccgtccgccgcttgcggggcccggtcgtcgggtgacagccgggagtggggcgggtgttcgcccatgcagacgcggcggacgacgatgagcatgtacgcggcggtgagcagggtcccgaacgcgccgatggccatgaaggtgcggaacgcggggcggctgaggccttcggcggggctgtacgcgccgaacagggtgagcatctcgccccagaatccggcgagtccggggaggccgagcgaggcgatggcggcgaaggcgagcagcgcgccgagtcggggcgcccggccgtagagcgcggctccggtcgctccggcgagggtgtcgaggtcggcggtgccgtagcggtccttgatggcgccgaccaggaagaacagcaggccggtgatgaggccgtgggcgatgttggcgaagagcgcgccgttgactccggtgggggtcatggtggcgatgccgagcaggacgaagcccatgtggccgacggacgagtaggcgatgagccgcttgaggtcgcccttggcgccggtacgggccagggccaggcaggcgagggagccgtagacgatgccgacgacggcgaacgccgcgaggtagggcgcgaaggtccgcatgccgtcgggggtgatgggaagcaggatccggacgaatccgtacgttcccatcttcagcaggacgcccgcgaggagcaccgacccgacggtgggggcggcggtgtgggcgtcggggagccagctgtgcaggggccacatcggggtcttcacagcgaggccgatgccgatcgcgagtacggcgatgacctgcacggacgtggtgaggccccggccgttgtcagtggcgagtgccaccatgtcgaaggtgccgctcttcagcccgatgaggaggatgcccagcagcatgacgaccgagccgagcagggtgtagaggatgaacttccaggcggccgcctgccgttggccgccaccccagcgggcgatgaggaagtacatcgggatgaggaccatctcgaaggcgaggaagaagagcagcaggtcgaggacggcgaaggtggcgagggtgccggattccaggacgaggacgagggcgacgaaggccttcggcgaggggcccgcgggcagcttgaagtagctgtacagcgcgcagaggaaggtcagcagcgcggacaggaccaggagggggagcgagatgccgtcgacgccgaggtggatgcggacgtcgagcgccgggatccagctgatgtcggtggtcgcctgcatcgtggcggggtggtcgtggtcgaagccgacggccaggacgatcgcggcgatgaggacggcgccggtgacggtgacgccgtggcggagcacggcctggtcggggttcttccccctgagtccgggcggggcggggagcagggccgcgacggcgccgaggagcggggcgacgacgacgaacgccagaaggaactgcatcacggacgcactgatatcgatcacggtcacgaccccgcgttgacgttggcgaagacgacggcggcgatcgccaggacgagggacccggcgagcagggcgctgacgtaggtctgcacattgccggtctgggcccggcggacggcggtgccgaggaggcgcgtgacggcgcccgttccgttgacgtaggtgtcgacgacctcgcggtccaggaagcggacgaggcgggcggctccctggacgggccggacgaacagcaccgtgtacagggcgtcgaggtggaagccggtcgccgcgtggcggtgcaggggcccgaggaggagcctgccgggatcggccgggtcgggggcgcccgcgatggtgccgtagacggcggtgtgggacgtcatggcctcggcttcgac

SEQ ID NO: 4171 - DNA, 837 bp, Unknown
  Kingdom: Bacteria, Phylum: Actinobacteria, Class: Actinobacteria, Order: Streptomycetales, Family: Streptomycetaceae, Genus: Streptomyces
cgccctgggcctggccgccgtgagcggatccggcggtccggtgtcggcggccaggcccagggcgaagtcctccagtgcggtggcggggtcggcggcccggtcgatgcgtccggtgagttcgcggacggcggtgcgggaccagaggtcggcgagttcgacccggtggtcgcgcagttcgtgcgccggtacgccgaggagtacgggggcggagccgggcgcgaaccggatcgcggcgcaggagccgcggtcgcgggggtcgacgtggaaggcgcgggtgtcgggcccggcgacgaccaggcgtccgggggtccagatcaggtccatgcagccgtccggcaggacggaccgggcggcctgcggggggccgggcgggacgtccagggtccagacgacggccccgtccagccgggacggccgttcctggtaccgctggtgttcccgggacatggttccacgctagcgcggtcagcgggagggcggttcctccgtcggccccggcgtcctgggctccgtcgtctccccggggtccttcacgtccttggaatccttcgggtccttgggttccttctcccaggccgcgtgcagccgggacttcacgtcgtcgggcggcaggaagcgggaccagcgctcggggaactctgagggcatgtacgcggggccgccgtcctcgtcatcgtcgtcgtcggggccggcgtaaccggccgagcgggtacgggcgacgaattcggcggcctgcgcggcccggacgcgttcggtggcctcgcgggcggcggccgtggccagcgagggccacacccggtcgatggccgcgttgaccgcggcgccgaccaggaccgc

SEQ ID NO: 4172 - DNA, 677 bp, Unknown
  Kingdom: Bacteria, Phylum: Actinobacteria, Class: Actinobacteria, Order: Streptomycetales, Family: Streptomycetaceae, Genus: Streptomyces
cggcggggtccgagcccaccacccgggcgcgagggtgtcaatgcgcatggccgttctgccgtatttgccgggaatagcgacgccttcgagccctgtggggctggtgtggcggccgggagtggctgaaaacgtcccatacctgccgtccgggggaacggaatgtgacccagagcacgttgggctcgttgtcataacgcctgcgtcacgtccacgtctgccacggcgaggcctgggtaggtctgctgtgtcctgttctccatggccaggaggccaccatgcccgctgccgcgcagcttctgctctccgccctctccaaacaggtacccacgcagcccgattccgggccgctgaccagtgaacttccccttgccgacgtcgcccacctgatcagtgggccgccgctcgccgatgtctccctcctgctcggcgaatcctcgttcgccgattccgcgccgctgaccagcgagcctccgctcgccgctgccacccctctcacgagcgagccgaccgcacccggcaccgcagggggcatggagttcccaggagtctgaatgggcttgtcccggctcgccgcactgcacggtgtcgccacctcctactccccgtcgccggatgtcacggtgtccgtccccgacgacacggtcatcgccgtgctcgccgcgctgggcgtcgacgcc

SEQ ID NO: 4173 - DNA, 1729 bp, Unknown
  Kingdom: Bacteria, Phylum: Actinobacteria, Class: Actinobacteria, Order: Streptomycetales, Family: Streptomycetaceae, Genus: Streptomyces
  misc_feature (639)..(640): n is a, c, g, or t
ggtcgcgagggccggggcggcggcttcgcccgtgcctccggtgggaatcggtcgcggcggtgggtcgtccggcagcgcccggcaggtcgcgtcggtctcccgcacgacgtagggcgggcggtgtttggcctcgtggtagatgcggcccacgtactcgccgatcaccccgagcgtcaccagctggatgccgctgagggcgacgacggcggtgaggagggtggcgtaaccgggggtgtccgcgccgtgcaggaccacgcccacgaccgtccacagcgcgtagaccagggccgagacgaagacccagaagccggtgtagatcgcgaggcggagcggcctgttgttgaaggagagcagtccgtcgatgccgtagttcagcagccgcctgcttccccatttcgaccggcccgccacccgctcgctgttgcggtagcggaaggtgaccgtgtcgaagccgatccaggagaagatccccttggagaagcggttgctctcgggaagggacaggacgctctccacggcacgcctcgacagcagccggaagtcccccgagccgtcgatgagctccacgtccatgcagcggcggacgagcgcgtagtaggtgtggctgagggtgctgcggagcaggccctcgcccgcgcnnggtcggcgtccatgatcaccacggccgcaccccgcgacatgcggagaccggcgagcatggcggcctccttgccgaagttgcggctgaaggcggtgtagtgggcccgcgggtcgcgcgcggccagggcgctcagcagcaggcgggtgcggtcccggctgccgtcgtccacgtaacagatctcgaagctgtccccgagggggtccagaacgccgaccagggcggtgtggaaggcctcgatcacctcggcctcgtcgaaacacggcacgacgaccgacagctgagggccagtcacacgccacctccggacttcgggcccctcgtgggtgccggtcctcaccggcgcggcaccgtcggcctccggcaccgggccaccggaacgcgccacgtccgccccatctgacgacgggcgagggcctccgcccctccgcacacgcgcggggacacctctttcccgcgccctttcatgcgaacagcggacgcgggtcggcagaacgccgggtcgcgggggcgaaaaagcgcacatagcctcgcaaaggtgacatctcctcgactgccacggacccggcgcgccgcacccggcagggcctggcatcccggccggtccaccgggcctctcgccgatgcgctcaccggcctgctcgccgtgctgtccgccgtgtgctggctggtgctcaccgccgccggtccagcccgcgccgacgaccccgtcgagctgtcccgggacgggcagatcaccgaccgggtgggagccctgggcgaccggacggggcaggtggaggacgcgctcgaccggctgtacgacgacgagcgcatccagctcttcgtcgtgtacgtacgcgatttctccggccggtccggacagacctggagcgacgagaccgccgaacgcaacggactgggccaggacgacgtgctgctctccgtcgccacccacgaccggcagtacgcctactccgtcgacgccggctccccgctcaccgacgagcggctgcgggacgtggcgggcaccgcgatcgaacccgcgctgcgggagaacgactgggcgggagccgcgatcggcgcggccgacggttacggcgccgtgctggc

SEQ ID NO: 4174 - DNA, 831 bp, Unknown
  Kingdom: Bacteria, Phylum: Actinobacteria, Class: Actinobacteria, Order: Streptomycetales, Family: Streptomycetaceae, Genus: Streptomyces
cccggcgcgaacatccggcgcacccgcctcgcaccccgaaccccggcgcgaacatccggcgcacccgcctcgccccccgaaccccggcgcgaacatccggcgcacccgccgcgcaccggacctcgggccgtcggcgcaccccgcctcgcaccgcgtcccgggggccgtcagcgcgccccggtggccagcgcgcccgtcacaccctgctcctccggccccaggaaacgcgggtcgggccggagcagggcgtccagcgccgccttgcccgaggccgccagctcccgggcgccgccgtagtaccaggtggcgtcccgcggctcgtcgaccccgacgccgtacgcgtcgatcccggcggaccggcacagggtgaccgcccggtggatgtggaagccctggctcaccagcaccgcccggtcgaccccgaagatcttcttggcccggacgcaggagtcccaggagtcgaacccggcgtagtcgctcacgatccgctcgtcgggcaccccgcgcccggtgagatacgtgcgcatcgcgtccggctcgtcgtactccacgcggctgttgtcccccgtgaccaggacgaccttcaccttcccggtgcggtacagctcggccgccgcgtccagccggtgcgcgaggtacggggtcggccggccgttccacagcccggcgccgaacaccacggcgacctcccgcgccggagcctcggccgtcgtgcccacccggtcaccggactccagccgcatccaggtcgcgggcaccagggccagcgcacaggcggccatcagcccctgcaccagccgccgttgcacccgccgggtgcgcggcagccgc

SEQ ID NO: 4175 - DNA, 622 bp, Unknown
  Kingdom: Bacteria, Phylum: Actinobacteria, Class: Actinobacteria, Order: Streptomycetales, Family: Streptomycetaceae, Genus: Streptomyces
cacccaccgcacgcagcagggccagctccccggaccgctgatggatcgcctgggacagcgtcgaggcgatcacgaggagcgccaccatcagcacggtgccgccgatcgaaccgagcagggccaactggtcgccgcgtccgccgagcgcgtccacctgctcggcctccccgcgctccgcacccgtcagcacccgcaccccccggtcggacccggggacgcccgaacgctccggcaggaccgcgccgatcgcgttgcgcagcgcatcccgtgagacacccggctccgcgaccacgccgatcgcgtcgatccggcccggatgcccggccagggcggtcagccggtgctcggtgaagaacacggccgggggagcgtcgacccggtgcccggtgcgggcgatcccgctgaccgtgtacgtccgggcggtcccgtcggcccgcagcacgacccgctcgcccggggcgtggccggccaccgcgagcgagccgtccaggacgacctcggtcgcgtccctcggggcccggccctcggccagctcgtaccgggtgaggacggcggacggccaggagcggcccaccgcgggccgcccgtcgcccgtggacaccggcacggaatcgtccgcgac

SEQ ID NO: 4176 - DNA, 1014 bp, Unknown
  Kingdom: Bacteria, Phylum: Actinobacteria, Class: Actinobacteria, Order: Streptomycetales, Family: Streptomycetaceae, Genus: Streptomyces
acgggatgtcgtcgaaggcggcgagggcgatgtcgtcggggacgcgcatccctcgggcccggatcgcgtccagcgcgccgagggccatcaggttgtcggccgcgaacacgacctcgggcggctccgcgagggcgaggaagcgctcggtggcccggcggccgctggccgcctggaagtcgccctggccgatgtaggcgtcgggcagggcgagcccgagctcgcgcatcgcgtcgcggaaggcctcgacgcgctcgttgccggtggtggtggcggcgggcccggcgatgatggcgagccggcggtggccgaggccgtgcagatgcgtgacgagatccctgaccgcgcccgtaccgtcggcccgcacgacgggcacgtcgatgccggggatccagcggtcgacgaagaccatcggggtgccgctcagggcgacgtcccgcatcagcggggagcccccgtcggcgggcgagacgaggagcccgtcgatcctgcggtcgatgagcgtgcggatgtggtggtcctggagctcgggccgctcgtcggcgttgccgatgatgacgctgtaaccgagcgcgcgggcctcctcctcgacgaagcgggccagctcggtgaagtacgggttgagcacatcactgatgaccaggccgagggtgcgggtctgcgcggtgcgcagggagcgggccaccgcgttgggccggtagccgagggcctcgacggcggcgaggacgcgggtacgcgcctcttcgctcacggacggatggctgttcagcacgcgcgacaccgtggcgacggacacacccgcctcggccgcgacatccttgatgcccgccatgcccggaccacctccttgtggtttccgtacacctcgaaacccccgcgccgaccggtcgtggaccggtggctcgacgccatggaatcgattacacggatgattggaatcgattacatggccaaaaacaagcccccctcccgcgtccgagaccggatcgtgacgggaggggggctggggtgcgggac

SEQ ID NO: 4177 - DNA, 971 bp, Unknown
  Kingdom: Bacteria, Phylum: Actinobacteria, Class: Actinobacteria, Order: Streptomycetales, Family: Streptomycetaceae, Genus: Streptomyces
gggaggacgaacgggggagagggaggcgtgaggggtcaggcgcgcgggcgcaggccgagcttcgcgcgtgcctcgtcgggcgtggcgacgcgggagcccagggattcggtgatccgcacggcgcgctccaccaactggccgttggtggccttgacgcccttgcccagatagaggttgtcctccaggccgacccggacgtgtccgccgagcaggatcgactgggcgacccagggcatctgcatccggccgagcgcgaagctcgcccactgggcgccctgcggaagcatggcgaccatcgcctggaggacacccgggtcggccggcgcaccccacggaacgcccatgcagagctggaagaccgtggggtcgtcgagcaacccctcggcgaggagctgcttggcgaaccacagctgcccggtgtcgaagatctccagctcggggcggaccccgagctcctggatgcgcttcgcgccggtgcgcagcatgtcgggggtcgagacgtagaggttgctgccgtcgccgaagttgagcgaaccgcagtcgagggtgcagatgtccggcagcagctcctccacgtgcggcagccgttcgagaccgctgaccagatcggtgcccggcagccggcgcagcgggtccaccgggtcgatgacgaggtccccgcccatcccggcggtcaggttgatgaccacatcggtgccggtctcccggatccgctcgacgacctcacggtagagccgcggatcgcgggagggcgcgccggtctccggctcgcggacgtggatgtggaccacggcggccccggccccggcggcctcgacggcggaggcggcgatctgctcgggcgtcaccgggacatgggggctgcggccgacggtgtcgccggctccggtgagggcgcaggtgatgatgacgtcctggttcacgggcatggggaaacgtctcctctcggggagtgcggggagtgcggggag

SEQ ID NO: 4178 - DNA, 1909 bp, Unknown
  Kingdom: Bacteria, Phylum: Actinobacteria, Class: Actinobacteria, Order: Streptomycetales, Family: Streptomycetaceae, Genus: Streptomyces
  misc_feature (301)..(302): n is a, c, g, or t
ggaccgcccgtaccgcgcccgcggccggcgtcgcgccggcgatcccgcacagggcgggggccgggacggccgcgcgggcccgggtgctccgccgccccgccccgggggcctcccggtgggcggcgatgcggaggagcaggctctccgccgtgtgggggcgcgggcctcatgggtcggggcgagacagccggccgtcagcgcacgccggaacggcggcagggcctggtccctgcgcagcggcgcacgcccctgaccgtgctgaccggaccgcagtcgaccgcggagagcacctggcgctccnngcgctcctggtgccggagcgcggtggcgtcaggacgggcggtggtggcggtcgtcggcatcactgctccccgggatccggacgggacggtcgtgcgggcgccgtcgacaaggtagtgggggagcgccgggccaggcatccggaacgatccggagtgacatccgggagcccgtgccgttcccggaaccgctccaccccggtccgaccgggcccggcgccctgagaggctgttcacttctcggcgacccccggcggtcgcggtcccgttcccggaaggaactgccatgagcagcgcgtacgacgtcctcgtcctgggcggctcgggtgtcgacacgatcgtgtacgtccccgaactcccgcttccgtacgccgacagctacctgatccgccccggcatcgaggcccgcgccgggcagaccggcgacttcgtcgccctcggtctcagctccctggggctgcgcacccaccacatcgacatgatcggcgacgatccctccggggaactggtccgcgccttccaccgcgaccacgccatcgacttcaccgcggtgccgctgcccggcggcaccaagcgcgcggtcaacctcgtcggaccggacggccgccggctctccctctacgacggcagccgctcccacgtgtccgaccggctacccgaggagacggtccgcaccctggccgcggccagcacgcacgcgcacgtctccatcacctacccgtgcgcccacgcgcttcccctgctccgcgaggccggagtcacggtctccaccgacctgcacgactgggacggccagaacccctatcacgaggagttcgcctacggcagcgacctcgtcctcgtctccaccgctgccctttccgaccacgaggccaccatgcggcagatcatggagcgcggccgggccgaggccgtcgtcgccaccgccggggcggagggctcctatctgctcagccgtgaggccgacgggccggtgcacatcccggccgtcgccccgcccggcccggtcgtcgactccaacggggcgggggacgcctacgcctccggcttcctcttcggccgcctcgcgggcgaatccttcgagcggtgcgcgctgtacggcgcgatcgccggggcccacgcctgtacggtgcccgcgaccggcggcgatgtgatcgaccgggccgcgctgctggcggaagcggccgccctgtccgcggtggaggccgatgcgtgagcggcggagcgggtgacttccccgtggaccgggcgcggccgggtccctgatcgtcacccgctttgctctgccctaccggcctgcggctagtttgggtgcagcacaggtgggcgggcccgtggtggcagagaacgcacgggggacgggaggtcgggaagagtgtcgctgcgcggaggtgatccggtcgagatcggcggttatccgctggaggaacggctcggttcgggtggcatgggcacggtcttcctggcccgtacgagctcggggcggcctgtcgcgatcaagctgatccatcagcagttcgcgggggacgacgagttccgcatccgtttccggcaggaggtggcggccgcgcggcgggtgagcggcgcgttcaccgccgccgtggtcgacg

SEQ ID NO: 4179 - DNA, 613 bp, Unknown
  Kingdom: Bacteria, Phylum: Actinobacteria, Class: Actinobacteria, Order: Streptomycetales, Family: Streptomycetaceae, Genus: Streptomyces
tcggcgggcgggtcgccgtcccacacctcgtcgacgaggactccggccgggacggtccggccgggacgcagcgcgagcacggtgagcagggcgcgcagccgcgccccgccgagggggacggccgtgccgtcgtcgcggagtgcccgggtggtgccgaggatgcagtagcgcacgggcccattgtccgtgacggagggaagcgcggagtcgaccgggtggaactccacaaccggtctccgacgttccagccctgtcggaccgtacgatccccctttcccttgatccgcctgccccctcaccccaggagccgagtgccgatgaccaccgcagccacccgcggcgaccggagaatcagcccggtcttcctcggcatcgccgccgtcaccgcggtcgcggggtgggcggtgtggacgggtttcgcggacgccaccggcttcgcggtgttcctgttcgtcaccggggcctggatcgtctcgctctgtctgcacgaatacgcgcacgcccgtaccgcgctgcacagcggggacctgtcggtcgggtcgaagggttatctgacgctcaatccgctgaagtacacgcacgcgctgctcagcatcgtgctgccggtgctctt

SEQ ID NO: 4180 - DNA, 1331 bp, Unknown
  Kingdom: Bacteria, Phylum: Actinobacteria, Class: Actinobacteria, Order: Streptomycetales, Family: Streptomycetaceae, Genus: Streptomyces
gcgagggctggctcacgccgaggcgtcgggccgcctgatgcaggctgcccgcgtcggcgatggcgcacagcgccctgaggtgcctcacctccagctccatgcagcggagactatgaccgccgcacgccgcgcaccagacgtcacacccccaccaaatggcagcaattaagggcgggttgggctccgggacacgtgatgatgccgtgctcaagacgtgagcacggcatgtccttgagcggctgacgtgcacgaagagggggccgggacggcgatagggcggcgctatcaccgttcggcatcatccccggcgactgtgtgctgccccacactcttccccgtaccgccccacgccttgtccgcccagcggacacccccacggcgcgggttcgatcggacaggtaggagaaatcccccccatgagacacctcaggactgccgtcgccaccgccgccgccgggctcggcctcgtcgccgcgctgggcaccgcacccgtcgtcgccgccgctccggcgcctgccgctccctcctcctccaccaccgtcgccgcgtacaacggctcgggcgagaacgccgccgcgaaccgcgccttcctcgacgccgtcatgaagtccgtcgccgagaagcgcgcggccaacccgggcatcaaggccgtcacggtcacctacaacgcgtcgaacgcgccgtcgttccgcggagagatagccaacagcacgcagatctggaacagctcggtctccaacgtccggttgcaggaaggctccaacgcggacttcacctaccgcgagggcaacgacccccggggctcctacgccagcaccgacgggcacggtcgcgggtacatcttcctggactacgcccagaaccagcagtacgactcgacccgcgtcaccacgcacgagaccgggcacgtgctcggcctgccggaccactactccggtccgtgcagcgagttgatgtccggcggcggccccggcccgtcctgcaccaacgccaacccggacgccaacgagcgggcccgggtgaaccagctgtggcagaacggcctggccgcgctcgcccgctccgcttcctgacaccgggacgcaccggcggtcaggcggaggacggccggtcccgtgtcccgggaccggccggaaccccccacacgacagaggaccgttccgcgagcggaacggtcctctgtgcggtgcccgggtgccggtcaggcgtcgagttcgctgcggacgagggccagcagctcgtcctcggtcatgccgaggtcccgggcgtccgcgacggcttcgcggacccgctccagcaaccgggcccgctgcggcgacgcgccggcggtg

SEQ ID NO: 4181 - DNA, 1182 bp, Unknown
  Kingdom: Bacteria, Phylum: Actinobacteria, Class: Actinobacteria, Order: Streptomycetales, Family: Streptomycetaceae, Genus: Streptomyces
  misc_feature (865)..(991): n is a, c, g, or t
ccccccaggtgcgcatgctcccccaccgtctcccggtctccgaactcccggcgcccgaggccaccgagggcggtggaatgcgcctcgcactcggtctcgaccaggacgcgctggagccggtctggcacgacttcagccggaccccgcacctgatcgcggtcggcgacaccgagagcggcaagaccaacctgctgcgcctcgtcacccagggcatcaccacccggtacacccccgaggaggcgaagatcatcgcggtggactaccgccgcaccctggtcgacgccatccccgaggagtaccgcatcgggcacgtcatctccctggacaacctcaacgagaccatcgagggcgcggcccgcgcgatgaagacccgggtgcccggggccgacatctcgcccgcccggatgcgcacctgcgactggtggaccggcccgcgcctgttcatcctggtcgacgactacgacatggtctccggcaactccttccagaaccccttcgagccggtcttcgagcatctgacgctcggctacgagatgggtctgcacctggtcgtcgcccggagcgccatgggcgcgggacgcggcctgagcgacgggctgatccgccgtctggacgaggccaacaacccggcggtcctgctctcctgtccgccgacggagggccgcctcttcggcaacgcgaagccgctcaacctgccgccgggccgggccctgcacatccagcgccgcaagccgcggctggtgcagacggccctggtggaacaggactgagagtacgaagaagggcccctccccgaggacgagttccgggaggggcccttcacgcgttcagctctcgtcaggagcgcccgccggacgccagcccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtggcacggtcggtgtcggaggtgtcgcgtacggccacgggctccgcggcccgctccgcaccgcccgcgggggtggccgcgtcgccgaggaccgtggtgacggctgcgtaggcgtccagttgggggatgtcggccgggtacgcggtggcggtcagccgacgggtcaccgcgtcggccgactcctcggggtg

SEQ ID NO: 4182 - DNA, 753 bp, Unknown
  Kingdom: Bacteria, Phylum: Actinobacteria, Class: Actinobacteria, Order: Streptomycetales, Family: Streptomycetaceae, Genus: Streptomyces
  misc_feature (516)..(524): n is a, c, g, or t
gcggcgatcgccgccgggacggtgctggcgacgccgggcgccgtgtcggcggcggacggcggactcccgccggagcaaccgcggacagccgaactggaggtgggcggtgcgccatgtgccaccggcgaggagcggccgtacgtgcggaccgttccgcaggtgacggcacggctgtacgggcccggcggcgggcagccgggtgaagcgagccgggtccggggtgagttcgaggcatggtggcagggagaggacggcgccgagaagcgcgtgacggcgaccaccagcacgatgcacgacaccgccccgttcagctggcagctgccgagcacgatccccgacgagaccaccgtgtcctggcgggtgcgggccgtgaacgacgacggggcctccgcctggagcagcgaaggggtgggcgcgccctgcgagttcgtgtacgaccgcaccctgcccgacgccccggtcgtcacctcccccgactatccggacgacaacacctggacgcccggcgccggtgtnnnnnnnnnccgaagacggccgaggccggacccgaccggtcggccgagatccgcttcgtaccgaagtcgtggggcgtccagaccctctccgtacaggcgcaggaccgcgcgggcaaccgcggcccgcgcaccgactacaccttccgggtcgccagggaaccggccccggtggcccactggaagctcgccgacgcggcgggctcccgttcggccgcagccgagaacggcaccgccgccc

SEQ ID NO: 4183 - DNA, 659 bp, Unknown
  Kingdom: Bacteria, Phylum: Actinobacteria, Class: Actinobacteria, Order: Streptomycetales, Family: Streptomycetaceae, Genus: Streptomyces
ccacgacaccggcgtccatctcctcatcgggggcgtgaacaaccggggccggggcgtgggcaccaccctgctccgcgccgtcgccgacctcgtcctggacaaccttccgcggtgcggacgggtcgtagccgagccggacctgcgcaacaccccatccgtatccgcgttcctcagcgccggtttccgcttctccgccgaagtggatctccccgacaaacgcgccgcgctgatgatccgcgaccgaacgtaccgagcccagctgtgacttactcgccgcactttccacaccgctcgaacctcataggttccatccggaggagtccccgtgccgatatatcccgcgagccgtgaatcagccgagtccccgcggctgttcagccctccggagctgaaccgacagatctgggaccgggccgccgcacggctcctcgccaagatgctcggcgagttcgcctacgagaagatcatcgagcccgtcccggagcccgggaccggcgggcgccaccggctgaccctcgacgacgggggagtgctcgccttcacggccaggcgcggcggtgggtgagccgtgggcgtgggcgtccgggggccccgccgtgacctcgatcgagtcggggtcgacgcgccagctgccgtagacgccgcgcctggccgtgaag

SEQ ID NO: 4184 - DNA, 1173 bp, Unknown
  Kingdom: Bacteria, Phylum: Actinobacteria, Class: Actinobacteria, Order: Streptomycetales, Family: Streptomycetaceae, Genus: Streptomyces
tcgtcggcctcctccagccgggcggcgaccatcgaggagatcagctgaggggtgtgcgagacgagggcaacggcccggtcgtgggcgtccgcgtccatgacgacggggacggcccggcacagggcgaccagctccagcgccaggttgagcacctcggtgtcggtgtcccgggtcggcgtgaggacccaggggcggccctcgaacaggtcggcggtcgcggcgagcggaccggagcgttccttgcccgccatgggatgcgtaccgatgtacggggtgaggtcgaggccgagcgcctccagctcgcggcgcgggccgcccttgacgctggcgacgtccaggtagccgcgggccaccccgtcgcgcatggccccggccaggacggcggcggtgtgcgcgggcggtacggcgacgatcgccaggtcgacccggccctggggcggctcttccgtgccggcgccgagtgcggcggcggtgcgcacggaggcggcgtcgtggtcgacgaggtgcacatggatgccgcggccggccagtgcgagggcggcggaggtgccgacgagcccggttccgatgacgagggcggttctcactgggcgatgtccttgcgcagagcggcggtggcgccgaggtagacgtggctgatctcggcgcgcgagagataggtctcgacgtgcacgaggatacggacgacccggggcatggccccgtcgatgtccagctcctgggcacagatcaggggtacgtcgacgatcccgaggccccgcgcggcggcggcggggaagtcgctgtgcaggtcgggagtggcggtgaaccagatgctgatcaggtcgtcggcgacgagctcgttgcggtccagaacggccgtcagcagctcaccgacccgccggcccatgtgcccggcctcgtcctcgtccagctggacggcgccccggaccgctcgtaccgccacgtcgcactcctcgctcttcgctgatcgtccgcgccgccgggcccggcgccgcacggcgcggccgacggctcacctcagcctagatcggacgcggcggacccggtcaccgcgttccgtccgtgagacggcggtgccgcgcccggggccccgggggcgggcccgtcagggccgtcagtgcctctgtcaccacccgggcgggcgcacgatccgcccgggtggtgacagag

SEQ ID NO: 4185 - DNA, 1874 bp, Unknown
  Kingdom: Bacteria, Phylum: Actinobacteria, Class: Actinobacteria, Order: Streptomycetales, Family: Streptomycetaceae, Genus: Streptomyces
gggcgggacgggggcggggacgtgacgaccgggacggaggcgtgacgacggaggggcgagccgcgctcaggagccggtcttcccgcgccgggccagcagccacggctccaccacgccgaggccgcgcaccgggcgctgccacatcggctggagcccgaagcggtacgtgggcagcggcggctcgtcgtcgggttcgcggccctccttctcggcgacccgggcccgttcggcggcggccgcgacggcctcggcggcctgcgcctcggactccggggcatcaccgtgccggaccagctccttggcgaacgccccgtcgaccaggacggcgtccttcggcgctatcgaggtcagccggctggcgaggttcaccgtggtgccgaagacatcacccatccgggtggtgaccgtgccgaaggcgatgccgacgcgcagggcgggcatcgtctcgtcctgggacatggcctcgatcagccggagcgctatctcggcggccgtgcccgcgtcgtcggcggcgaagaggacctcgtcgccgagggtcttgatgagccggccgccgtgcgcggcgaccaggtcggcggcggtcgtctcgaaggactcgaccagttcgccgagctcctcctcctccaggcgccgggtcagccgggtgaagccgaccaggtccgcgaagccgacggcgagccgccggtcgaccatctcctcgtcgtccgcggcctgcacgacccggccggtggcggcggccagctgacgccgccacacgtagacgaggaattcctggagctccgggagcagcagctcgaccagcggataggtgacctcggtgcgggtcatgccgggctcgggcggttcggtcagaccctccaggaaggagtcgatctgccactcggccagccgggcggtggtctgcccggtggagcgggcgacctggatcgccatcggctcgctgagcagccccgcctcgacgagaccggcgagccgccgcagggcgagcacgtcggcctcggtgagcgccttggcctggccgatgtcggcgaagcccatggcccgccagaaccgggaggccaggtccatggagaccccggccgtgcgggccgcctggaagggcgtgtagcgccggtcggcccccaggatcagcgcttcgaggcggatggcgagggggtcgtcggtcggttccaccgtgtggtcgacctcgtggtggggtgtggcgtggaccgaggagtccggcccgggctcctcacccgcgccggacgtcgtgtcgccgacggtcaccagccgcctcctgcccgttccctgcgcactgccctgccgatctgtcgctggatcgcctcaacgatacggcaggtgtgccccagctcacgtccttggtcgcgcgtccccggtgcgtcgcgcgtgacatctcaggcatacgcggtatccgcccgtacgccgtcggtggcacgcctctgtctcaggtcaggccgcccgccgcgccccgcaggtggacgatgtccccggccgacaccggttgctggagcccgtcctcggtggagaggaccaaccgcccgtccccgtcgatcgcgaccgcctcgccgaccagggacgtaccccccggcagctccgcccgcacggtccggtccagcgtcgcgcagcccgccgcgtaggcggcctggagcccgctcgcggccgcgtcgccgtcggccgccttccaccgcccgtaccagtcctccagcgagcgcaggacggcgcgcagcagggtctcccggtcggtggagaccgccccggcgagcgccagcgacccggcggtgggggcgggcagttcgtcggcgcggagcgagacgttgatgcccaggccgacgacgatgccgtccccggcgaactcgccgaggatgccgcccgtc

SEQ ID NO: 4186 - DNA, 808 bp, Unknown
  Kingdom: Bacteria, Phylum: Actinobacteria, Class: Actinobacteria, Order: Streptomycetales, Family: Streptomycetaceae, Genus: Streptomyces
gcccgccactgtccgcctccacggtgatgtcctcggccaccggcaccagggccgccaggtcggcctcctggcgggtcagcttcccctgggcgacgaggggacccagcagcgcgggcggggccggggagaggaacctctcggccacctcgggccgggagaccttcgccagcaggcgggcgcgccggacgatgccgccgtccgctccccggcgcagcccgcgggccgagcacaggacgaccgccggggtcagctccatgaacgccgacgccgagatccggggaacaccggtgcgcagcagcagttcggcgacgcgccactccagcgccggttcggccggcgagtggatgaggttgacgccccagttcgatcgggaccccagctcgtgcgccagggtccggacggcccgctccacctcggggtaggccagaccgcccgcgccgaagaagccgagcatctctgccccggccatcgcggagaccatccgggtggtcgcgatgccgttcgccatctccccggcgacataggggaagcggacgtcgtgcgcttcgcagaaggtgcgaccgccgagccactccgggtacagcggcggcagcgtaccgagcaccgggccgtcgggcagcggaccggtcgcgagccccaggtcacggccgcccgggccgctgacgatgtggacgggctcccggatccgccgggcacgggccgtgattccctccggcgagaaggccggtggggacgcggcgggggagccgggagtggcgaggacggacacggggggctccaacggggtgggacgtctgctggtcatgcg

SEQ ID NO: 4187 - DNA, 1772 bp, Unknown
  Kingdom: Bacteria, Phylum: Actinobacteria, Class: Actinobacteria, Order: Streptomycetales, Family: Streptomycetaceae, Genus: Streptomyces
gcgcccggaggccgcgcccgtcctcccgcggcgtcaccggtcgggcgcggcctccgggcgcgtgtaggtacggcccttccaggcggcgccccgaccccggtagtgctgcaccgccgagtccacagtcatcagcaggtacagcaccgccgtcagcggcagcagcggacccagccacagggactggcggtagtaggccagcatcggcagatacgtcgccgtcatcaccgcccacgccgcgccgcccgcccaggccgccgcaccgtcacccgtcagcagccccgccaccagcgtcgcgggcggcgccacgtagacgagcagcaggcccgggaccgttccggccagcagcagcggactgtgccgcaactgcgcgtacgcactccgcgcgaccatccgccacagatccgccagccgcggatacggccgcacgctgtccacccgctccgcgagacccagccagatccggccgccgctgcgccgcacctcccgcgccagcgacacgtcgtcgatcaccgcctgccggatcgagtccgggatccgcgcccgctcggcggccgcggtgcgcagcaggacgcagccccccgccgcggccgccgtccgcgaccggacccggttcacccggcggaacgggtagagctgtccgaagaagtacacgaacgcgggcaccaccagccgctcccagacgctctccacccgcagccgcgccatctgcgacaccaggtcgaagccgtccgggcccccggagccggccgcggccaccagatcgcgcaggctgtccggctcgtgcgcgatgtccgcgtcggtcagcagcaggaagtccggcttgtcccgccgggccaccgcgatcccgtgccgcagggcccagagctttcccgtccagccctgctccggctccccgggcgtcaccacggtcagcgggaacccgccgtaccgggcggccaggtcccgggccagctgcccggtgccgtcgctgctgcagtcgtcgacgaggatgatccgggcgtcccccggatagtcctggaccagcagggacggcaggctcaccggcagcatctccgcctcgtcgcgggccggcaccaccaccgccaccgacggccagcgcgccgggtcggcgcgccgggggagccgctggtccgtccgccagtagaagccctgccccagcagcagccacacccacgcgatcagtgaacccacggcgatccaggcaacggcgctcatccgcggaagtctgccccactgagcccggtccgcaagggctgtcggctagggtgaccgggtgaagatcgcgctcatggactccggaatcggcctgctggcggcagcggccgcagtgcgccgcctgcggcccgacgccgaactcgtcctctcctcggaccccgactccatgccctgggggccccgcacacccgaggacatcaccgcgctcgccctgaacgtcgcccgcgccgccgccgcccaccggccggacgcgctgatcgtcgcctgcaacaccgcctccgtccacgccctgccggcgctccgcgccgaactggagcccgcgcttccggtcatcggcacggtccccgcgatcaagccggccgcggcgggcggcggctccgtcgccatctgggccacaccggccaccaccggcagcccctaccagcgcgagctgatcggtgacttcggcgggtccgccgaggtcaccgaggtcccgtgccccgggctcgccgacgccttggagcacggcgacgaggccgggatcgaccgggccgtcgcggcggccgccgccctcaccc

SEQ ID NO: 4188 - DNA, 3716 bp, Unknown
  Kingdom: Bacteria, Phylum: Actinobacteria, Class: Actinobacteria, Order: Streptomycetales, Family: Streptomycetaceae, Genus: Streptomyces
tgcggggccccacgcgcgcacgccgccgggtcctccgagaagcgggcccggtgcgtccgcgacggcacccggggccgcctactgcgggcggccgagtgcccaccccgacacgtcggcgaggcgtccgcgccacagcggcagggagaccgggctcatcgccccgacgacgagcgtgacgtcccgcagatggatccagcgcggcagccgggccgtctccgcgtcctcgtcggcgcgcagttcccgtacgccctggtcgaccgtctcggggaactccgcgagcaggttggccccctcgccctcgacctggcgcaggctcctggcccactcggccttccactgctcgtgcccgatgacgtccccgtgcagcaggccgcccgggtgggtcagggtgagaggcaggctggagcgggggtcctcgtcgaggagctggatgagcagttggagctgaaggtcgggcaggggttcggtgatcaccgcggcggacggtgccggtgaggtgtcggcggtggcgctcatgggcccttcccttcacatggcggacgacggtcgtcctccccgcctgcccggcgagcgcgggagcacgcccccgaggggagcccggtctcagaggaaacggcggatgggcagcacggctgcctcccgcgcccgctggaggaggtcgcggcgcttccaccggccgcgctcgatcagcacgctcttctcccggtcctcgtcgaagtggccgtcgagggcggcggtgaagtcccggtcgaggacggcgagcatgacttcctcgtcgtggtcgagcgagcgccggttgaaattggtggagccgatgaggctcgcgatccggtccacggtgagcgtcttggcgtgcagcatcgtcggctggtattggtggatcttcacgccgcaggcggtcagctcctcgtagaagcgctggccggcgagctggcagacccgcttgtcggtgtgcggtcctggcagcaggatctcgacctccaccccgcgccgtgcggcgtcgcagagaagcccggtgaagtaggcgtcgggcgcgaagtaggcggtggtgaggcggacgcgttcctcggcggactccaggacgacccggatcagggtctgcatgtcctgccagccgaaggacgcggagccccgcacgacctggacgacggcgtccccgtggcgctcgctcacgacgaaccggtcgcgctcgtcgaagagctcctcgtggcactcggcccagttctgcgcgaacgcggcggccaggccgtcgacggcggggccggtgacccggacgtgggtgtcgcgccactcgtgctcgttgcgggcgtcgccgcaccattcctcggctatcccgacgccgccggtgaacgcggtgcgctcgtcgacgacgaggaccttgcggtggcagcggtggttctgcttcatcggcgagaggtggaggggtttgcggaaccaggtcacggtgaccccggcccggtccatcagctccagctggtccttctcgatgagccggcagccgaacccgtcgagcatgagccgcacccgcaccccggcccgcgcccgctcggccagcgcctcggcgaaccggagagcgatgtcaccgcgccagtagacgaacgtcatcaggtccacggtgtgctccgcgccccggatggcctccagcatcgcgccgaagatctcgtcgccgttacggagcggaaggagggcgttcccctcggtggcggcgatcccgatcagccgctccagcctgcgtcggagccgcagggaccgctcctcgcaggtgcgggcgtccagggccgtggggtcgggggcttcggcggtcgcggacatgggtcacctggcggggatgcgggctgggacggcggtccggccggaaccggacggaccgcgaggacccggcgactgtactcctgtacgaatccggacggaatcggcctccgctcccgagagggcgcgggcacgcacccttcagccggtggacgggaccggagccgggcctcgcgtcaggtcgcgggctcccacccgacctcctcgttgccgtacacgtactccggccgccccttcatcccactggtacggaacggcttcccgtggtcgtcgatccgcagcaccccttccttcccgccgctgctccactccagctccaggtaccaggtgacgtcgtaaccgacggccttcatatcgaggttgaagacctccacgtcctcggacgtcaccctgtacgggaagtccacggccggaaccaccacgtccccctgcttccccggcaccggccggagggtgggatgcccggcgtcgagatgggcggcgaaggtctggggcgcgatcccgctgccgcagccgttgcccatcagatacgccgaccagggcagcggagccttgcgggagaggacgcgtacgtgcatgcccttgaggaccactgcctcgcgggaggtcccctgcacggtgagctggagcagcatgttcccggcgtcgaccccgccgtacgactccgcccagcggcgccggtcctgcggcgcgggcggcgggtcgagttcgtcgggcccccggttcaccaggtagtgctggccgcagggttcgtcccagttgtacgaggagatggtgacggtcggcggagcaccgaggcccgtaccgctgccgccgccggcaccgccctgcgactgccccggcccggagcccgccgagggtttcacggacggcgaccccgagggggacgcggaggcactagccgaaggaccggccgaactcgggctcgcggagggccggggcgtggccgaggcggagccttccggagcgggcccgaggtctccgccggcgtcctccacccggtccgcggcgctcccgccgtcctccctccccgagccgaccaggtcggcggcgacgacggtggtgggtacgaggagcgcggcgaccccggcggcggcgatgagcacccgcgtacgccgggagagccgggaccaccgggaggccgaccccggccgagcgccaccggacacgacagacggctcgacggcctcagcggcttcgccgccttcgggaacaacaccaggcacaggagcagaagcaggagcaggagcaggagcagaggcaggaacggggacaggaacggggacagggtcagaggcaggcacagactcggccgtccccggcgccgaccccgccggaggccgccgccgcgccgcgtccgccacgatccaccgccggtgcacctccaccagctcgtcgccggacgccccgcacacccgcgcgaaccgctccaccggggcgaactcgttcggcacggcgtccccgttgcagtaccggtggagcgtcgacgtgctgacgtgcagcttccccgccagcacaccgtagctgcgccccgaacggtccttcagatccttcagcagagccgcgaactccacggcctccggcgtcgccacgacggcgttccccttcctcgtgcgtcccggaacggcgttccagggacgcggaatccccgcaggtcaccgtacgcgtagtcattccagcatccccaatggttcggcaggcgttgcggccggaatccgccgtgccacaagctcggaccagaccacagcaggacccagcaggaccacggaccggccgttcaaccggaccaacacgtcaaccgatcacggggagtaccaccgccatgcgcaccaaccgcatccgcaccaccgccctcgccgccaccgccctcgccgccgctctctcgctcaccgcctgtggcggcgagg

SEQ ID NO: 4189 - DNA, 2231 bp, Unknown
  Kingdom: Bacteria, Phylum: Actinobacteria, Class: Actinobacteria, Order: Streptomycetales, Family: Streptomycetaceae, Genus: Streptomyces
tccgcgcgggccaccggcctggcgttcggcgtgctgggcgtcggcaaggtcgtcggcgggatgctcggcggacgggcggtggccagcgcggagtagccgaggacctcctggaggtacagggtgagcaggaacaccagcgaggtctcggtgacgaaggcgatcagcccggcggcgtttccccagacgacgctccgccgcttcaggatgtgcatcgggacgagcggcgcggtggcccgctgctcgatgcggacgaacgcgaccaggagggcgacgccggcggccagggaggcgagtgtggtgggggtggtccagccggtctcgccggcctgggtgaggccgaggacgagcagcagcagtccgccggtgacggtgaccgcgccgggcacgtccagccggggccgccgctccggccgggagtcggtgatcacggacggggccaggatcaccacgagggccgcgaccggtacgttgatgaagaaggcccagcgccaggagagcaggtccgtcaggaggccgccgaggatcgctccggcggtgaatccggccgacatcagggcgccgttgagccccagcgcccgttcgcgcagcggcccctccttgaacgcggtggtcagcagcgcgagtccggcgggggtgacggccgcggtggccaggccctggagcacgcgggcgacgaggaggacctcgggcgaggtggcgaggccgccgagcgccgaggagagcccgaggacgaccatgccgccgatgaacaggttcttgcggccgacgaggtcggcgacgcgtccgaagagcagcgtgaatccggcggcggcgagcgcgaaggacgtggcgatccactggaggtgggcgagggagaagccgagtccttccccgacgacgggcagcgccacgttcaggatcgagaagtccaccgcgatcatgaactgggagccgagcagcagtgccagcacgagcttctggcgtctcgtcatgcgggggccggcggcgcgggggacgctcgacggtccggtgggtgtgggagagggtgcgggtgaggtacgggacatggcggggcgccttcctgggcacggaatggcttaacggttctgtggttccgttaaggtggtgtcaccgtaacagggggagcgttgttaatggaactggagacccgttatgacttctgaaggttctgagggcctcgacgccgacggtggggagccgggcaccgtgcgccccggtggccgcaccgcccgggtgcgggaggcggtactgcgagccgccggggacgcgctggtcgagcacgggttcgacgggctcgacctggccgacgtcgcccggcgggccgaggtcggcaagacgaccgtctaccggcgctggtccgcgcccgccggtctggtggccgatctgctctcggacatggcggagcagtcgctgccgcgcgcggacaccggatcgctggccggggacctcagggccaacgcccgactcgtcgtccgcacgctgaccgacccccggcaggggcccctcttcgtggccgtcatcgccgccgccacctgcgatgcgcgggccgccgacgccctgcaccgtttctacgcggtgcggatcggggagtggtccggctgtgtcgaggcggcggtcgatcgtggcgaactgcccgccggcacggacccgggcgaggtgatcgcggcggtgtcggcgcctctgtactaccggctgctggccagcggggcgccgctggacgaggaggcggcggaccgggccgccgccgccgcggtcgccgccgcgcgggacggggtgtacgtacggtgagaggcgggggacgctcttggcggcgaccggcttcacggctcccggacgcacgtcgataaagtgccggaatgatattcggtaaagccgggttcgggggtgcggtcgccgacttcgaggcggcggtgaccgcgcaggacgccaagcgctccggcagggcgttcgtccggttgcaggagaccttcggccaggccagggagacggagctgctggacggcgggccgcggctcgccgccgtgctggagcaggtgccgcccggcccccgcgccgtcgtcgccgtgctcgtcggtgcctgcgtcgagcgcggtgcggacgccgagcgctgcgcaccgggggtgctggccgggctgcggtgggccctggagcaggccgtggtgttctccgacgcctgggtcgcgaccggtggcggcgcgtttcccgttccggacggcggcgagccgggcccg

SEQ ID NO: 4190 - DNA, 3366 bp, Unknown
  Kingdom: Bacteria, Phylum: Actinobacteria, Class: Actinobacteria, Order: Streptomycetales, Family: Streptomycetaceae, Genus: Streptomyces
gctgcaccggtcatacgcaggtggcggcggggcatggcccgagcgtaggccgggtgggggcgcgcggcatccggggcgctcgcggtcccgcgcgtacagggggcgcggcctcgccctacgggggccggcgtcccgtccccgtacccttgccgaggacccggagagcccgcacgccgaccggatccgtgcttgcgccgtacgtacgaaggagaaccgccgtgctcgtgctgttgccgccctccgaaggaaaggccgcctcggggcgcggggcttcgctgaagccggagtcgctgtcgctgccgggtctcgccccggcccgtgcggcggtgctggacgagctggtcgagctgtgccaggcggacgaggagaaggcccgtgaggtgctgggcctgagcgtggggctgcggggcgaggtcggcaagaacaccgagctgcgcaccgccgggacccgtccggccggtgagctgtacaccggcgtgctgtacgacgccctcgccctggcctcgctggaggcggacgcgcggcggcgggcggcgaagtcgctgctggtcttctcggggctgtggggcgcggtccggatcggcgaccggattccgccgtaccgctgctcgatgggggtgaagctgcccggtctcggcgcgctcggcgcgcactggcgcaccccgatggagaccgtgctgcccgaggccgccgggaacgggctcgtcctggacctgcggtcctcggcgtacgcggcggcgtggaagccggcgggcgaggtggcctcgcgcacggcgagcgtgcgggtgctgcactcccagctggtgggcggggtggagaagcggtccgtggtgagccacttcaacaaggcgaccaagggccggctggtgcgcgatctgctggtggcgggtgcgcggccgaagggtccggcgcagttggtggaggtgttgcgggacctcgggtacgtggtggaggccgaggcccccgcgcgggccgggcgtccgtggtcgctggacgtggtggtgacggacatccactgaccggccccgaccggcgtcgttgcgcactgcgcaacgctcgttgcagatattgtcttgggcgcggcaggatgaccccatgacctcctctgccgcgccctccgccccgtccgacgcctccgtgctggatctcgcacccgtcgtccccgtcgtcgtcctgcacgacgtggccgacgcggtgccgttggcgcgtgcgctggtggcgggcgggcttccggcgatcgaggtgacgctgcggacgcccgccgcgctggagtcgatacgggccatggccgccgaggtcccgggcgcggtggtcggcgcgggcacggtgatctcgccggagcacgtacgggacaccgtcgacgccggcgcccggttcctggtcagcccggggtggacggacgcgctgctggaggcgatgaaggcgtccggggtgccgttcctccccggtgtctcgaccacctccgaggtggtggccctgctggagcgcggggtgcgggagatgaagttcttcccggccgaggcggcgggcggcacggcctacctcaaggccctgtccgcaccgctcccccaggcccggttctgcccgaccggcggcatctcgctcgcctccgcgccgtcgtacctcgcgctgcccaacgtcggctgcgtgggcggcagctggatggtcccgggcgacgcggtggcggcgaaggactgggaccgggtggcccgcctgacggccgaggcggcggcactcggcgcgtagtcgcgaaggcgccctcgccaccccgcacaggcggcgaccgccccgtggtcccgcgcgcggggagccctcagcgcaggatctgtacggcgtagagcccgccgactccgagggccagcacccccagcagcagccgcagcgccgtctccgggaggcggggctggaggcgtgcgccgaggtagcccccgcacagtccgccgagtccgcaggccaggccgagggaccagtacggcgcgatgtcgccggtggtggtcagggacagcagcgcgtacgtccccgcgccgacggccgaggtcacgaaggtggcggcgagcgcggccggcgcgaccttcgccaccggcatgccgcgccccacgaggatcgggccgaggagcgatccgccgccgatcccgtagatccctccggccacgccgaccgccatggcgagccgggtgacggcgcgggccgagggctcccgctcgggggccgttcgggaggcacggcgcagggtgcgcaggcagagccagcttcccagcggcagcagcaggacggcgatgagcagccggaacaccgtcggacccggcaccgcgaacacccggatcaccgcgccgacgacgacaccgggaaccgtgcccaggacgagcagccgggtcagcggtccccgcagggtgccggccctgtggtgccgcagcagggccccggggcccgccaccacgttgtagagcaggttggtgggggtgaccgccgggctgggcaccccgagcacgctgatctggaccggcagcaggaacaccgcgccggagacacccaccggcgcggtggccacggagatcagcagccctgcggcgaacccgagcagcccggtcgaccaggtcatagggctcgtgtttccgctagcgcaggtgggacgtgtcgttgagcaggcgtacggaggcgttgccgtccgcgtagtgggcgaccgtggagatcgaggccgccgacagctccatcctgaacagcgcctcgggcggggctcccagggcgagccggacgagcgtcttgatcggggtcacatgggtgacgagcaggaccgtgcggcccgcgtaccgggcgacgatccggtcccgggcgaccgcgacccgctcggcgacctccgcgaagctctcgccgccgccggtcggagcggtgtccggggaggccagccaggcggtgaggtcgtcggcgtaccgctcccgtacctccccgaaggtcagtccctcccacgcgccgaagtccgtctcgcgcagtccctcgtcgatccgtacgtcgaggccgaggcggtcggcgacggccgcggcggtctcgcggcagcggcgcagcggggagctgacgatctcctggacggtgcccagggcggcgaagtactcggcggcccgctcggcctggccccggccggtggcggagagctcggggtcggtgccgccgctgccggagaaccgcttctcgggcgtgagggcggtctcgccgtgccggagcaggacgagcgtggcgggcgcgccaaggtcgggggccggaccccagccggtctgcggggctccggcctcctccggcgcggttccggcaggctgcccggggtgccggacatcgcggtccccgcggcgccggtctccgcaccggcccccgggc

SEQ ID NO: 4191 - DNA, 1621 bp, Unknown
  Kingdom: Bacteria, Phylum: Actinobacteria, Class: Actinobacteria, Order: Streptomycetales, Family: Streptomycetaceae, Genus: Streptomyces
cgggcggaggcaggaacgtggaggtggaagtggtggaagtgggggtggcggtggcggtagtggcggacgaggaatcgggcgacggagcagaggtggacagagcgccgggaatcgacgcccgaggagatcgaagggccatgcctcacgacgttaggcacatccacccgagcccgctgagcagcgccgattcctgtggacagtccagcagttgtggacaactcggtcaccccccggagtgagactccgcagcgcgtccacccatgggcgttcaccgcaacgcggtcagcgcaacgcgcgcccaccgcacccggtcagagcccggtcaccgcagcgagatgaccgcaccgagcagcccgggccccgtgtgcgccccgatcaccgcaccgacctcgctgacgtgaaggtcgaccaggccgggaacgcgttcgcgcagccgctcggcgaggcgctccgcacggtccggggcggcgaggtggtggacggcgatatccaccggagccgtccccgcccgctcggcgacgatctcctccaggcgggcgatggccttcgatgccgtccgcaccttctccagcatctcgatccgtcccgcgtccagctccaggatcggcttcaccgccagcgcggaccccagcagggcctgcgccgcgccgatgcgtccaccccggcgcagatagtcgagagtgtcgacatagaaatatgccgaggtgcctgcggcccgcttctcagcggccgacaccgcttcgtccgggtcaccgcccgcctcggcggtctccgccgccgccagagcgcagaatcccagggccatggcgaccatgcccgtgtccaccacgcgtaccggaacgggggcgtccttcgccgcgagcagcgccgcgtcgtacgtgcccgagaactccgacgacagatgcagcgacaccaccgcgtccgccccgccctcggccgccgtccggtaggccgcggcgaagacctcggggctggggcgcgacgtggtcacggagtggcgtttctgcagagccagggcgagcgagcgggccgagatctccgtgccctcctccagcgcccggtcgcccaggacgacggtcagcggcactgcgatgatgccgtgccgttccatcgtcgggcgcggcaggtaggccgtggaatcggtgacgatagcgacatggcgggacatgagccggaggttacctggcgtacggggagtgcggcagcccgaccccggcccgctgatcattcatggccgcttcggagcgtatccggtcgggtcatatccgctcgggcggtcgaacggccgggggtgcgtcagttcgtcgtctccggccgggtggacttctgccaggggtaggtcgtgcgcagccgcgggtcctgtgcggtgatcgcctgcgggctctcctcgcgggccggtccggaccacgcctggtcggccgtgctgctgttccccgccgaggggtccgccgacgcggcgggctcgggccagtccgtcccggggccgtggcccggtgtcggggcgggggcctccgcgccggaagcctgtgacggctcctcgaccgtccagtgccgcagcgcgccggcctcgatgtcgatctgtgcgttcagcgcgtccaggtcgtcgtcggcgaactgccgc

SEQ ID NO: 4192 - DNA, 531 bp, Unknown
  Kingdom: Bacteria, Phylum: Actinobacteria, Class: Actinobacteria, Order: Streptomycetales, Family: Streptomycetaceae, Genus: Streptomyces
agtcgggcgccccggccggccgatgtccgcagacccgcccgtaccgtcagcgcgtcctcggccagcccggccgcgggacgcggctcgggggcgtacagcacctgctccaccgagctcgcgatccggtgcacggcctcggccgccgtggtgtcgagccggcccagccgcacgatcctggccgccgccttccggggtgtcagcgactcgtccggagcgatgccgtggtcccaggcctcgtcggagatctcccgccaggctgccagcgtccgcgcggcggcgtgcgccggcgtccggccaccggagcccagtcggcggttccgcgcccggagtcgccacaggaacggcgacagcaccagcgccgccaccagcaggaccgccgtgtgaacgaccagcaacaccttccagagcggggtgccccggtcggtcggcagcgccgctcccggctcctgcgagggaccgcacccgccttcctggcgcaactgcggcgggcagctgtcctcggcagagggcgccgcggacggttcggcggag

SEQ ID NO: 4193 - DNA, 1506 bp, Unknown
  Kingdom: Bacteria, Phylum: Actinobacteria, Class: Actinobacteria, Order: Streptomycetales, Family: Streptomycetaceae, Genus: Streptomyces
tgcggaggcgccgccggccggggccacgaaggcgccggtggccgaggctgccagggccggggaccgggcagactcgacaggaccggcggcatagcatcggaccggacgcggtaccggaccgtcagcgtccgtaccgcgtccttccggcaggacagttcggccccgcccttccggcgggaccgctcggcggagaggtccgcgcaagacgaggagagtgcgccatggtgtccgagtccgaccgcgagtccgtgtccgagccggagtccggggccggggccgaccgcgcgaacgacgccgtgcggaccagcgtgtggctggaccggcagaccccttcgcgctcccgcaggtccgagtccccggcgggcctggaccgcaaccggatcaccgaggcgtcggtgcggctgctggacgccgacggcctcgccaagttctcgatgcgccggctcgccgccgagctggacgtcaccgcgatgtccctctactggtacgtcgacaccaaggacgacctcctggaactcgcgctcgactcggtctacgccgagatcgccccgccccgcgaggacgccgactggcgggaccggctgcgggagctggcccgcagttaccgcgaactcctcgtccgccatatctggatctccccgctggccgggaccttcctcaacatcgggccgaactccatgctgttctcgtacgccgtccaggacgtcgtacgggccaccggactgcccctggaacggcagacgggcgcgctctcggcggtcttccagttcgtgtacgggttcggcaccgtcgagggtcacttcaaggcacggtgcgacgcgaccgggctgacccaggacgagtaccaccagcacgcgatgggcaggatcagggcgcagccgcacatgcggcagatcaccgaggcgtcggacgagctgatggcggcccggggtgggaagacggtcgaggagatgcgcgaacgggacttcgtctacgcgctggacctgctggtcgcgggcatcgaggcggtgcgcgaccggacgggctcgcccgcccggtagccgcgcaccgcgttcgcgttcgtcagccgcgtaccgcgttcgtcagcatcgaaccggcttcgacgcgcgcgtaccggcttcagtaccctcgccccacgtccaccgtcagctcgggacggcggcctgccgtcacgtcctcccagcaggcggcgaagtcggcggagacgtcctcgtcggtggtgatccccgaggagtgcgaggtgatgaccgtacggggcagcttccacaccgggtcgccgggggcggccggttcctcaggcagcacgtccagcaccgcccggcgcacccggccgtcccgcagcgcggtctccagcgccgccatgtccacggtcgcgccccgccccacgttgacgaacgtcgccccgtgcaccgccgcgaaccgggcctccccgaagaagccctcggtggccccggtcagcgggagcgtggagatcacccagcgggcctcgcccagcacctcggtgtc

SEQ ID NO: 4194 - DNA, 714 bp, Unknown
  Kingdom: Bacteria, Phylum: Actinobacteria, Class: Actinobacteria, Order: Streptomycetales, Family: Streptomycetaceae, Genus: Streptomyces
gatgggggtggcggagcccagggcgccggcggcctgggtgggaaagtacatgatggcgcgctcgacggcgtcgtacgggagcatcccgaggatctccggcaggatcatgaccccgccgatgaacgcgccgatcgcgccgggcaccgaacgcaggagtgcgccgaggccgagagcgatcaggcccagcagggtgagagctccggcgttgcccgccagggcacgcaggatgcccgggtcggtgaacgaggcggcctggtcggtgtcgtggaggaaggcctgcgccgccgcgaacgtgaccagggccgtcgcgaacatgaccgtgaagaccttggcggcgaacaccgcggccttggcccacaggacggggagccgggccggtacggcggtgagcgaggagcggatcatgccggtcgcgtactcgccggcggtcatcaggatgcccaggacgaccaggcacaactggccgagcatgctgccgtacagggtcaggacgaccgtgtcgacgtcggagtcaccgccgccggaggtgtaggtcccgcccatgatcaggccgactcccaggaccatggcgaccgccgagacgacggtgatccaggtggagcgcagggagtggagcttgtgccattccgagcgcaggatccggggcgcggtgatgcggtaccgcgatgagggtgatggcggtgacgggggtgtgatcgggctcgggggccgaag

SEQ ID NO: 4195 - DNA, 552 bp, Unknown
  Kingdom: Bacteria, Phylum: Actinobacteria, Class: Actinobacteria, Order: Streptomycetales, Family: Streptomycetaceae, Genus: Streptomyces
  misc_feature (239)..(240): n is a, c, g, or t
tcgtcgccttcggctcgtacctgctgctggagaactccgaggcgaacgagaagtccgacgacgcctcggcggcccaggacggcaagcacccgggcgggcacggcgactcccacggcgacgcctcggccggggccatcgaggggctgaagtcctgggacgcggcgaagctcggccgcaaccacgtcgcgggctcggtggactatccgatgaagcctccggtcggcggcgaccacaaccanncacggcgcggtctgggtcacctacaacggcaaggccgccgacgccgatgtcgccgcgctggccgagcgcgtcaagaaaaccccgttcacgctgatgagcccctacaccggtcaggagggcgcgatcatgctcagcgcctggggcaagcaggtcgccgtcgactcggccgacgacaagcgggtggaccagttcttcgcccagtacgtccagggcacgcagacccccgagcccggcgcaccctgcaccggcgggttggccacggtgccgcagtgacggccggggacgtcacggacgagcggtcggcagctgaag

SEQ ID NO: 4196 - DNA, 3273 bp, Unknown
  Kingdom: Bacteria, Phylum: Actinobacteria, Class: Actinobacteria, Order: Streptomycetales, Family: Streptomycetaceae, Genus: Streptomyces
gccttgcggcggggcgggcgaagcgtcttgatgctgcggcacatgactccagtgtgtaccgccccactgacaacgcacacccgtcgccgtcgcccgccccgccgcaaggccggttcgcctgccggccgctcgtcgctcagctgcggcgcacctggtccctcgggttcgaccggtcggtgcacagggcccagatgacgaacacgtcgatcgcgatggtgacgatggcccagaccggggtgtacgggagccacatgaagttggcgatgaggttcagggaggcgagaacgacgcccgcgccgcgggcccaggtcgcgcctttgaggatgcccaggcccacgaggatgaggaccacgccgaggatcaggtggatccagccccacgaagtcacgctgaacttgaagacgtagtcgttgatccgcgtatagacgtcgtccgaggcgatccccgcgatgcccttcagcactccgaggatgccgtccacgaagagcaggacaccggcgaacaccgttcccccggccgcccacgggctgccggagttgccacccggacggggatctgcggggcgcgatgtgccgggtgcgggggtactgggctgtgacatgaggactccttggccggaacgaggcgccggggcgcctgctgtcctgacctgccctggaggtgcgtggcagatcagctccgacgctcctcccggcccccgggcggggccacccggacgcacccgttcgggtgacgtgtcacggcgcgctgaccgtgacgacgcgtccctgggcgtcgacggtgagcgccacccgctcgacgcggttggccagggcgacgacggcccacacgatcccccacgccaggcacgagaagacggtgaggaaggcgtgcagcacatgattcaccggctgcccgcgcaccagcaccacctggctcccggaacgcgactcgacgcgccagccgctcgcgatgcgccggctcacgatccagtccaggatcagtgcgcgctccgccgcgtcggggggtccgcacccggcgacgtaatagccgggcggcggctcgatcgaggtgctctcccgtaccgttcggcgacgtctcacggggtcactcccaggtgtcgaggtcgccgccgcgccattcgatcagcccgggccggtccagctcgacgaccttgtcgggccccggggcgaaccccgcggcccgcagcagcgcggccacctcgccccgcccgtgcgccaggcccacgatctgcccgtgcacggtgacccgccgccctccggtcgcggaaggcggatagacgatcacaggcgggtgctcggccatgcctccacggtgccccgagcactgcccccgcgcatcccgggaggggctcgctcccctcggtggaaccgcccgagcgcgtcgcggcgtccccccggacattcgtacgatcatgaaccgcgacggaggacccgcccatgacgacaacggctgcccgctacctgtacctcacgcggcacggtcaggcctccgccgacgagagcacgctgaccgacgacggccgccgccaggccgccctgctcggggagcggctccgcgaggtcccgatcacggcgatccaccacggcccgctcccgcgcgccgagcagaccgcgcggctgatcggcgagcggctggcgggggttcctctgctgcggtccgaaccggccggcgactacatcccgtacctgccgcgacgggaggagctgccggcggagtcggccgacgagacgctcgcccggctggccgggttcccggcggccgagcgcgagcagggtcccgggctggcccgggaggctctcgcgcggttcacgggaacggtcgagggggacgaaccccgccacgaactcctcgtgacccacaacttcctcgtcggctggctcgtccgggccgcgctggacgccccggactggcgctggctgggcatcaaccacgccaacgccgcactgaccgtcatccgttacgcgcccggacgccccccggccctcctcctgttcaacgacaccggccacctgcccgccgaactccgctggaccggcttcccgcccgagctgcacgtctgaggggggcgcacgtctgagggggacgcggcccggcacaggcggtgcggtggctcaggcactccgcccgcgaccgcggatcaacgacagcagcagcgcgtgcgtttcggtgtccgcggccacgacgaggccacggccctccggcccgaccggagcgccgtcgaccccggtgacgacacagccggcggcccggcacagggcgatcccggcggcgaagtgcacgctcccgctcaggtcgccgccgtcggtgacataggcggcccgcctgccggccgcgacccaggccagcgcgagcgtcgtggagacgacgcgcgggcggaagcgttcgacgaacccggggtgggcgagcaggtcgacggcacggaaagcgggcgcgcccgggaagggcgggtcgaggttcacgtccaccagccgggtgtcggccgtcggcgccaactgctcctcgccgagcggtcgtcgacgcacgacggggccggaggcgtgcccgtccgcaacgcgtcggccccggacggcggtctgcccgcgcccgtccccgtccgcctccgcgccgtactggacccacgcggtcccgccgtcggtgaggaagacctcgccgctgaacggatcggccaccgccgccgggccgttgcgcagcgccacgttgacggcgaccaggtgggagccggtggcgtagttgagcgtcccgcacaaggggtccaccagccactcgcgcaccgcgccgaccgcgcctcgccgaccgccctcctcgccgtgcaccgcgtccccgggccgggcggcacggatgacgtcgaggatcgcgtcctccgccgccacatcgacgtcggtggcgaagtccccggcgcctttgtcgatacgggagtgcggccgcccgtaccgggtgcgcacgatctccgccccggccagcgccgcgactgccgccacctcggtgtccgtcgggctcgcgggtgagtcgatcatggcgcgcagagtagcgggaggccgccgtacggggaacccggcacagccgtcacgctccccccgcctcctgcgcccggccgagcagcagcgcctccgagccgaccggccggaatccggcggcctggaacgcccggatgcttcgcgcgttgcccgcggcctgctgcgaccagagcggttcgcccgggggcacgaggtgccgtgcggcggtggcgagagcgcggccgaggccccggtgccgggcatcctcgtccagctc

SEQ ID NO: 4197 - DNA, 4093 bp, Unknown
  Kingdom: Bacteria, Phylum: Actinobacteria, Class: Actinobacteria, Order: Streptomycetales, Family: Streptomycetaceae, Genus: Streptomyces
cgccgtcaccgaggtcgtcaccacgacggccaccggctggcgcacccacggcggaacctgggacgccaccgccctcggctggcacgtccggcccgagccgggcgacggctgccgggccatcgcggagacccgggcgcacgacaccgagtaccgcgccgacctccagatccacgaccccgacaccacggcgacgctcctcctgcggaccgacgcgggaggtaccaccgggtacggagtccaggtacaaccgcacctgaaccggctgaggttgtaccgcatcgacggcgacgtcaccctcggctcccacgaaaccaccgtcgagccgggccaggtctaccgcctgctcgtccgggccgacgggcccgagctgcgggtgcgctggcagagcgacttcatcacccccgacggctacgccccggtcatcaccgcgaccgacaccgctcatgcggccggacgcttcggcgtcgcggtcaccggcggcgcggcctccttcgagaacctcgccctgaccgatctggtcacggacctcgacggctggaccacggcatcgggcacctggacccccgacctgcgcggcatccgtgccgaaggccccgccgccctgcgcaccgcccccttcgcctccggcgacatcctgctgagcgcggacctccacccggcgggcgccacggccgtgggcctggtcgtgcgcgcggacgcccgggggaggggcggttacgaggcccggctcgacgccaccggagtgtccctgctggaccgcgcggtcggcaccgtactcacccgagccgccctccccgtacgcccgttcgaggcgaggagcacctacaggaccgaggtgcgggcgctcggccggaacctcgccgtgaccgtggacggcgtccccgtgctggaggccaccgtcacccgcaccacgggtgcgacgacggccctgaccacgaccggcgggaccgcgcacttccaggaagtccgcgcccgcactccgcagagctggttcaccgacccccaccgcccggcccagcactacacccagctcgcctcgcacaccagcgaccccaacggtctcgtccatcacgagggggaataccacctcttccaccaggactcgggcgagtgggcgcacgccgtctccaccgacctgctgcactggcgtcacctgcccgtcgcgctgcccgtctccgaccacggccacacctggtccgggtcctgtgtgtcggacaccgacgacaccagcgggctcttcggcggcggcagcggactgatcgcctactacaccagctaccacccggacaaacccggcggcaaccagtgcgtgcgcgtcgcgttcagcaaggaccgggggcgctcctgggaatggcacggacccgaccccgtggtccccaaccccggtggaccggacggcaactgggacttccgggacccgaaggtggtccgcgacgaggagcacggccagtgggtgatgacggtctccggcggcgaccacatccgcttcttcacctccaccgacctcctcacctgggaccaccgctcctccttcggctacggcgagtgggtgaccggtggggtctgggaatgcccggacttcttcccgctgcctctcgacggcgacgccgcacaggtgcgctgggtgctggcgatctccacgggcgccgtccgccgcaccgacgggtcggccgccgaatacttcctcggcgactgggacggcgccgccttcaccaccaccaacacccccggcaccccgctgcgcgccgaggcgggccgcgactactacgccgccatgaccttcgccggcctgccggacggcaggcgcgtgcagctcgcctggctcagcaactgggactaccccttcagcgctcccaccggggagtggaacggccagctggggcttcctcgcgaactgaccctgtccggcgcgggacttctccagcggcctgcccccgagacccgtgccctgcgcagggaccggacccgcatcgaggacgtcaccgtcggcccgggctcccccgaccccctcgccgggatgcgcggccgctcctacgagatcgaggcggagatcgccctgcccgcctccggcgcggccaccgaattcggcctccggctccgcacgaaccggacccggcacaccacgatcggctacgacaccggagcgggggaactcttcgtggaccggacggccagcggcccggcggacttcaccgaacacttcgcgggccgcagctccacacccctgccgctcaccgcggtcgacggcgaacgacggctgcgcgtccacctgttcatggacaccagcgccgtcgaggtcttcggcggcgacggccgggccaccctcaccagcctgctcctgccggaaccggacgcccagggcatgtccttctacgccaccgggggcgccgcccggatcgtcaccctcgacgtgcaccggctggcggacgtcttccgtgtcaccgaccgtgaccccgaccgcccggcaccgccggctccgggagagttccgcaccagcggcctcggtgcgctcaccgtcctcccggccggccgctggaccaccaccggggcgggcagggccgggcacttcgaccgggactcgaccgcgctctccagcaccgagtacggcgacttcgagctgaccacgctggtccggttcggcggccccggcccggcggagggcggcgccggctcggtcctgctgcgggcctccgccgacgcggcggacgcctacgcggtcaacctggacccgaacctgcgcaccctccggctcttccgccgggacgccgggcggagcacggtcctcgccgaggtacccctgctcgtccgcggcgggaccacgctgccgctgctcatccgcgcccgttccacccgtatcgaggtgctggtcggcgaccggacggtcatcgacaccgccgacggaacccatcggcggggcaggatcggtctgaatgtgttcggaggccgcgccgcctaccaggacacccacgtcacggcactctaggagaccccatccccatgctcgaccacagcgaactgctggtcgtcggcgaatgcgtcgccgacatcgtccggctgccggacgaggccgcccgggtccacccgggcggcagccccgccaacgtcgcgtacggcctggcccgcctcggccaccgggccgtcctgctcacccagctcggccccgacgggaacgggcggctcatccgggaacacctcgcctccggcggagtcgacgtccgcaccgacggctcctccgcccccactccgtcggccgccgtcaccctggacggggccgggcaggccagttacgccttcgacgtctcctggaccctcgccccggtcgccgtcgaacccgctcccgtccatgtgcacaccgggtcgatcggcgcggtgatggagcccgggtccaccgcggtcctggacatcgtgcgcgccgcccgggccaccgcgaccgtcagttacgaccccaatgtgcggcccgccctcatgggagatcacgcggcggccgtgcgccgggtcgaggagtgcgtcgggctgagcgatctggtcaaggcgagcgacgaggatctggagtggctgtatccgggggaggagccggagcgggtcgcggcgcgctggctggggcgcgggcccgccgtcgtactcgtgacccggggtggcgcgggggcgctcgccgttctgcccggcggccggatcacggttcaggcgccggcggtcgacgtcgtggacaccgtcggcgcgggcgacgcgttcatgtcggggacactccacgccctcgccgcgcacggcctcctcggccccggggcccgtgaccggctgcacgccgtcgaccgggacaccgtcaccgacgtcctgcgccacgcggtcgcctccgccgccgtgaccgtctcccgggccggggccagtccgcccggcgcggacgagctccgcgaggcgctcgcacgtaactgacaccacgtcatgacccgttcggcgcagtcgaacgcatcctcgtgagacgttccgccgttcgtcaaccggatgcagtacgacaacgggatcggggcaacgggtggcgaggagacggacggccgacagcggtacggagccggggacgcgggcgggtgtcttaggg

SEQ ID NO: 4198 - DNA, 1004 bp, Unknown
  Kingdom: Bacteria, Phylum: Actinobacteria, Class: Actinobacteria, Order: Streptomycetales, Family: Streptomycetaceae, Genus: Streptomyces
tgaggcggtcgccagcagcagatgcgtctcggcctcctcgtaccgggacagcgccatcaggcagacgccgagcgtctcgtggcagcgcggcaggtcggggcggcccgccacggcctcgctcagcagggcgaccgcccggtcgtggtggccgcgcccccggtggatctcggcgagctgccggaccaggtcgatcggcggccgggagcggtcggggaacgggagcgcgaggtgcagcagcaggtcggggtgtctggcgccggggagggcgaggaaggccgcccggaacgcctcgtcgtccaggtcgaagcggtccctggccgcgtgggcgggggcgaggccggtacgggtcgcggggacgccggcgaagttcaggacgacgacgtcctcggggaccggcaggtcgccgtggagccgccgcgccgggaagtcggcacgggagtccaggggtacgaggaggccttccgggacatccttcgcggcgggcggcaccggaccgaggtcctggcgctggatcaccagcagtccgtcgtcggggaggccgccgcgcgggtccggggcgccgtcgggaccggggcgcggcacggcggccacgcccgtacggagtctcagcagggcgtcgagccggccgaggacgaccatggcgggggtgagggcgaccacggtgtcgtacccgtcgaggcggaacacgtcgtcgcgtccgccggccgtgcgcgggatcagccgggggtgcagccggcgagcggtgtcgaaggcggcgtccggcaggccggggtgcaggacgacgacgtcctcgcagtgtgccgggtcgctcagcgcgaggctgcgcaggagtgtccggagtccgggcagttcaccggtgccggcgacgtgcacggcgaaggcgatccggcgcttcccggtgacggcacggcggtcgtcggcggacacggccgccgtggcgtcggcggatgcggatgcggtcgtcgtggcgggggtgccggagtcggtcgccgtcgtcgtggcgg

SEQ ID NO: 4199 - DNA, 4717 bp, Unknown
  Kingdom: Bacteria, Phylum: Actinobacteria, Class: Actinobacteria, Order: Streptomycetales, Family: Streptomycetaceae, Genus: Streptomyces
ccctctcggcggtccccgacccctccggcaccccggaaccggcctaccgggtctccctcgccacctgccaggaggacgtacgcgcggcccagcgcctgcgccacctggtgttcgccggggagctcggcgcacggctggaaggccccgaacccggcctggacagcgatgccttcgacgcgtactgcgaccacctgctggtccgtgagaccgccaccggggacgtcgtcgccacctaccggctgctgccgccggaccgggcccggatcgccggacgcctctacgcggagagcgagttcgacctcacccgtctcgaacccatccgcgacgacctcgtcgaggtcggccgctcctgcgtccaccccgcacaccgcgacggcgcggtcatcgccctcgtctgggccggactcgcccgctacatggagcgcaccggccacagctggatcgcgggctgctgctccctgccgctggccgacggcggcgcgagcgccgcccggagctggaacaccgtgcgctcgggacacctcgccccggagaagtactgggtcaccccgcaccgcctctgggactccgccgcacacggcacggaaaccggttcccggtcggacctcccgcccctgctgcgcggctacctccggctcggcgcccaggtctgcggagccccggcgtacgaccccgacttcaacgtcgccgacctgtacgtcctgctctcgctgcgccgcaccgacccgcgctacctgcgccacttcctctccctggccccgttgcgatgagcgtctggctgcccgtcgccccgtgcaccccggacggctgcgcccggcacaccggagccgtacgcgctccgctgcccgccgccgtgctgctgctgtccggctgcgcactggtcctgctgggggtggcctgcgtcccgctggcccggctgctcggggaagctcggcggggccggctgacacgacgctgggcgcgcgccgtcccccgggccttcggcgtacgcgtcaccgtccggcggcacgcgccggaacccgccacgggcggcgaactcgtcgtcgccaaccacatctcctggctcgacatcccgctgatcgcctccgtgctgcccggccggatggtcgccaagagcgagatcaggcgctggcccctgctcggccccctcgccgcgctcggcggcaccctgttcatcgaacgcgaccggctgcgcgccctgcccaccgccgtacggaccgtcgccgcggccctgcgctccggctcccgggtcgtggccttccccgagggcagcacctggtgcggacggaacggcggcgcgttccggcccgccgtgttccaggcggcgatcgacgccggtgcgagggtccggcccgtccgcatcgcctaccgcaccgcggaacaccgctccggaccggccgcgggcgccgtcgcgttcgtcgggtccgacccgctcgccgcctccctgtggcgggttgtgcgagcggccggcatcaccgccgaggtcgacgtcctcgcgccgatccccgccgacggcgaggacggccgccgtaccctggcccgcagagcacgagcggccgtcctcgaacccgtggacggcctcctgccccgtcagaccgccgtggccagcgacagggcgaaccggcccgcccagtccgtccaccactgagtcagccgcataccggcggcggccagctcctcgcggacgtcctcctgccggaacttcgccgacacctccgtacgcaactcctcaccggcctcgaacggcaccacgaggtccagctcccggatcttgacgctcagcgcccggcgggcccgcagtcgcatctcgatccaccggtcccgcgggttccacaccgcgaggtgatcgaagtcgtcgagcgggaaatcggcccccagctcacggttgacgacgttcagcacgttcttgttgaaggccgccgtcaccccggccgcgtcgtcgtacgcggccaccagcgtctcctcgtccttcaccaggtccgtgccgaggagcagcgcgtcaccgggcgagagcagcgagcgcaccgaccgcaggaacgccgcccgctcctccggcagcagattgccgatcgtgccccccaggaacaccaccagccggggacccggcgtccccggcagggccaggccgccggtgaagtccgcgatcagcgcgtggacggacaggccggggtgcccggcgagcagtgactcggccgcccccgtcagcgcgctctcactcacgtccacggggacgtaactgtgcaactcgggcaggacgtccagcagatgacgggtcttctcggacgaccccgagcccagctcgatcacggtccgggcacccgacgccgcggcgatctcctccgcgcgcgccgcgaggatctcgcgctccgcgcgggtcgggtagtactccggcagccgggtgatctcctcgaacagctcgctgccgcgggcgtcgtagaaccacttcggcggcagggtcttgggatgccgggtcaggccgctgaggacgtcggcgcgcagcgccgcgtccgtcgcgtccatcggcagggtccgggtcagcaggaagggactcacgcggtgggctccttgagcggggtgagcaggacgtccgtggaggtcgcgaccagcagggtgcggtcggggacctcgcgccagagcgggtcgtcgtcgtacggctccgaggcgaccgcggtgcggcggcccggcgtcgtgaggtaccagagggtgtcgccccaggcggtcgcggtgatcgtctccccgtcggtgaggagcagattcagccgggatccgggagcggcggccgcgacctcgcggacggtctccgcgacggcgcgcggcacatcgtccccggcatcggtccggtggcggatcagcgcccagatcagcgccgagtcgttacgtgcggccagcgacaggagcctctcggcgggcagggtggcggccgcgtcggcgagtgagccgggccagccccgcaccatcccgttgtggctgaacagctgccgtccggcggtgtacggcgcggccgcggcctccccgtccgcacccgcctcggtggcgtcccgtacggcggcgagcagcgcggtgctgcggaccacccgggccagatcggtgaacgtctcgtcgccccatatgggtccctggcggcgatagcgtccgggcaccgggtccccgtccgcataccaaccgaccccgaaaccgtccgcgttcacggtgccgtaacgctgacggcgcggcgcccaggactgccgcaccaatgcgtgcggaggccgcagaagaatgtcgccgagtgtcaccggctcgccgacataggcgatatgacggcacatcaggcatccctcgccgtgcggaacccggagaagatctgccgccgcaccggaaggtcccagttgcggaaggtgccccggcaggcgacctcgcccacggcgaacgagccgccgcgcagcaccttgtgcccgggtccgaagaacacctccgagtactcgcggtagggaaacgcgacgaaccccggatagggcaggaagtcgctggaggtccactcccacacgtcgccgatcaactgccgtgctccgaagggcgaccggcccgccgcatacgacccggaccgcgcgggacgcaggtggcgctgccccagattggcccgctccggcgtcgggtcctcgtcgccccacgggtagcgccgggagcggccggaggcgggatcgtggcgggcggccttctcccactcgctctccgtgggcagccgccgccccgcccagcgggcgtacgcgtccgcctcgtaccagctgacgtgcagcaccggctcgtcgtccggcaccggctcggtcaccccgaaccggcggcgcagccactgtccggcctcctgccgccagaacagcggtgcggccaggtcgtgttcacggaccatcgcccagccctcgggagcccaccaacgctcggtccggtatccgccgtcctcgatgaacctgaggtaggcgccacaggtgaccggagaggtgtccaggcggaacgccaccacgtcgcgccggtgcgcgggccgctcgttgtccagggcccacggctcggcggaggtccccatggtgaacgggccaccaggaaccaggacctcgtccgcgagttcctcggtgtcggcgggtgcgggcggggcgggcgcggtcagcgccgccggacccgcgcgcagctgatgcgtgatcaacatcgtctcgtcgtgctgctgttcgtgctgggcgatcatgccgaaggcgaacccggcgcgctccaacgggcgtccgccctcgtgcagcggtgtgccctccagcaggtccagtgcccggccccgtacgtcggaggcgtacgtcctggcctcggcgggggccagtagcgggagtgagggacgcgaggcgcgcgagtgctcgaaggcgttgtacaacccgtcgatctccgggcgcagcgcttcccggccgccgaccgcgcgcagcagccactgctcctcctggttgccgatgtgcgccaggtcccagaccagcggcgacatcaacggggagtgctgggcggtcagttcaccgtcgtccacgctgtcggtgagcagggcggtgcgctcgcgcgcggacagcagcgcgtcgagggcatgccgccgcagggcctcgggatcgatgccgggcgcgacggggaagccggtcgacgcggtggatccggccggatcgaaggcgtcggagtgctcgcggtgccgggtgtcttcacggtgctcggtcatgcggaggcc

SEQ ID NO: 4200 - DNA, 1461 bp, Unknown
  Kingdom: Bacteria, Phylum: Actinobacteria, Class: Actinobacteria, Order: Streptomycetales, Family: Streptomycetaceae, Genus: Streptomyces
gcacgccgaacggctgctggccctcgggctgttcgaccgtccccggctgtcggtgcccgtcgcacggctctccaccggccagcggcagcggctcgccctggcgcggctggtcagccggcccgccgacgtcctgctgctcgacgagccgaccaaccacctctctcccgccctcgccgaggaactggagagggccctggccggtttcgccggcaccgtcgtcctcgtcagccacgaccggttgctccggcgccgctggcagggggcccggctcgcgctgcgggccgtccgagtgcccgcgctcagaggctgagacttcggccggtccccgcactccctacccgaaacgagtgatcacccttgtccccccgccgctcccacatcgcgatgatcggcatcccgatcgtcagccacgtcctgcccggcctcggcatcgtccgggagctggtggcccgcggccaccgggtcacgtacgccaacgacccggtcatggcggaccggatcgaggccaccggcgccgaactcatcccctgcacctcggtgttgccggtcgccgacaacaactggccgacggaccccgtcgccgcgatggacctcttcctggacgaggcgatccaggcactgcctcaactgcacgccacctacgaccacgatcccgcggacctgtacctgtacgacatcggcgcctacgccgcacgcgccctcgcagaatcgcaggggcggtccctcatgcagctgtccccgtcgttcgtggcctgggagggatacgaggaggaggtcgcggcgcatctgcgggggctgcccggcgccaccgagcaccgcgagaggttcggccgctggctcgccgactgcggggcgaccaccctcgacgtggacgccttctccggtccccccgcgcgggccctcgcgctgatccccgaggccatgcagcccagcgccgacagggtcgacaccgggacggtgaccttcgtcgggccctgcttcgacgcccgcgccgacaccggccggtggacccggcccgaggacgcggagaaggtcctgctgatctccctcggctcggcgtacacgcaccggccggagttctaccgccagtgcctcgcggcgtacgggaacctgcccggctggcacgtcgtgctccagatcggccggcacaccgacccgcgcgagctcggcgacatcccgtccaacgtcgaactgcactcctgggtcccgcagcgggcgatcctggagcaggcggacgccttcgtcacccacgccggcatgggcggctgcggcgaaggactcctcgcgggcgtcccgatgatcgccgtaccccagggcgccgaacagttcatgaacgcggaccggctggtggagctgggcgtcgcccgccgcatcgacaccccggacgccaccgccgagaccctgcgggcggtttccggatcggtgaccaggtcgttcagggccgcccgcagggtctcggcg

SEQ ID NO: 4201 - DNA, 961 bp, Unknown
  Kingdom: Bacteria, Phylum: Actinobacteria, Class: Actinobacteria, Order: Streptomycetales, Family: Streptomycetaceae, Genus: Streptomyces
tcctgtccccgctactgaagaacacgaccgaggcccggatccacgtggatccgggcctcggtcgtgttccgcctgcgtgccgtggtccccgccggacgctcggacatccctcccggacgctgagccatgggcgggggccgccccgccgggcgaggctggtgccatgactcagacagatgtgacccccgtgcgggaacccgtactcgtgaccggcggcaccggcaagaccggccgccgggtggtggcccggctccgtgagctgggggtggagacccgggcggcctcgcggtccggcgacaccccgttcgactgggcggaccccaccacctgggcagccgccctggacggcgccgccgccgtctacatcaccccgctcgacgcctcgccctccccgacgcccgccttcgtcgagcaggccgtcgcgagcggggtgcggaggctggtgctgctctcggcccggggcacggacgagccgggctacttcggccccggttacgaggacggcggcccgcacgccgagggggagcgggccgtacgcgcctccggggtgacctggacgatcctgcggcccggctggttcgcgcagaacttcagcgagggcgtcttcctcgacggcgtacgcggcggcgagctggcgctgcccaccggggacgggagggccgcgttcgtcgacgccgacgacatcgcggccgtggccgtcgccgcgctcaccgaggacggccacgcgggccaggagtacggactctcgggaccccgcgcgctcggcatcgacgacgtcctggacgagatcgcgaaggagaccgggaagcgcgccgcgtacgtccccgtcgacgcgtccgacttccgtgccgggctcgtcgcccagggcttcccggacgaggaggccggcctctggacggacgcgctgaagccgatcaccacgagccgggaggcacccgtcctggacggggtgcgccgggcg

SEQ ID NO: 4202 - DNA, 846 bp, Unknown
  Kingdom: Bacteria, Phylum: Actinobacteria, Class: Actinobacteria, Order: Streptomycetales, Family: Streptomycetaceae, Genus: Streptomyces
ttgtagaaccggtcgaagacccgctcccgggcctccggcggcagtcccggaccgtggtcggcgacctccagcgtcacccggtcgccgccgggcgcggccagggcgaccgtgaccggcggcgcgccgtgccggagcgcgttgcccaccaggttcgccacgatcacgtcgatgcgccgccggtcgaccacggcccttacgtcctcccggagttcgacggtcacccggtccgtccacccgcgcagcgccagcgacgcccgtacggtgtcggcgaggtccgtcacggtcgcgttgagccggaccgccccggcgtcgaagcgggagatctccatcaggtcctcgaccagccgggacagcctcgccgtctccgcgccgacggtacgggccgcgtgggcggcgtccggcggcagctggtcggcgtcctcctccaggaccgtcgccaccatcgtcatcgccgccagaggcgtgcgcagttcgtgcgacacgtccgccacgaaccgccgcgccttcgcctcctggctccgcaactccgcgtcggacgcctgaagtgcgtcggcggtctcgttgaacgtccgcgccaggtcggccagttcgtcgtgtccacggaccgccacccggctgccgaggtccccggcggcgagttcgcgggtggcccgccccagctgccgtaccggccgcaggaccgtcccggcggccagcagcgccagcagcgccgccagcaccaccacgggaacggtccccgtccgtacggagtccagcagggcggccgtgtcgtcgcgctcggcccgcaggtcggtgatcacgaagacctccaggcccgaggtgcgccggtccccgtcggcgtacgtc

SEQ ID NO: 4203 - DNA, 2391 bp, Unknown
  Kingdom: Bacteria, Phylum: Actinobacteria, Class: Actinobacteria, Order: Streptomycetales, Family: Streptomycetaceae, Genus: Streptomyces
gtactggctcggccggttcgccggggtcgccgccgacgcggccgcgtgcgcgctggccgcaggtgacgaggtgagcgcggtgaccctgctcgaatccgggcgctgcgtgctcgcggcccaggcactcgacagccgcggcgacctctccgacctgcgcgagcgggcgcccgagctggccgaacgcttccggacgctcaccgcggagttcgagaccgacaccgcgagcgaccgcgtggccctcgccgacgagctcgacgcggtgaccgaccgcatccgcgcgctgcccgggatggagcggttcctgcggcccccgctgctcaccgacctcaccgcgcaggcgcacgagggcccgatcgtgtacgtcaacgtcagccggcaccggtgcgacgcgctgatcatcactccggacggggttcgctcacgcgcgctggacgggctgagcgaggagaacgtgagccaccgcgtgcgcgctctgcacaccgcgttcacgcagggacggctggccgccgagcaaacgatccacgacacgctcgaatggctgtgggacaccgtcgcggggccggtgctcggcgagctggggctgacgacggaaccgccggcggaccgtccgtggccgaggatctggtgggccccggtcgggccgctcagcctgttgcccctgcacgcggcgggccaccaccgcgacggcggacctgtgctcctcgaccgcgtcgtctcctcgacgacgccgacgatccgcgctctgggccacgcccgcgccggccgccgagacgaccggaacgagccgcggatgctggtggtcgcgatgccgcacactccggacgccccggatctgcccggcgcacaggccgaagccgaccacctggccgctctcctgcccggtgccacggtcctggtcggcgcggacgcgacgcgtgacgccgttctcgacgccttgccggccagtggctgggcgcacttcgcctgccacgggtacagcgacccggacaacccatcggacagccacctcgcgctgcacgaccacgaccgcgcgccgtttcgggtgctggacctttcccggttgcgcctgcggaacgcggagttcgcgttcctgtccgcctgcgacacggcccgcaccacggtgcgcctgtccgacgaggcgatccacccgctggcggcctttcagatagccgggttctcccaggtggtcgggacgctctggcgtgtcgacgacgcggtggcaccggctttcagccgacagatctacggtgagctgatcgcggatcgatccggcgcgttgtgcgcgtcggcggcggtccatcgcacggtcagacagctcaggacgacgtatccgaacctgccgtcggtgtgggccgcacacgtccacgcgggcgcctgaccacgcgcactccgtcgtcccaccccccccgcaccgcgggcggtggcgggccaggcgcacgccgcgccggtcaggtcgaccagaccaccctgccgttgtgcacgacgaccaccttggcgtcgggcctcaggaccagctgggcgccgccgaagtcatgggttttggacgcccagatggctcggtcgtcgccgttgtggacgaccaggttgccgtcgggctggaagatcgcccggtggttctcgccgaaggtcatggcagcccagatcggcttgttctgctcgttgtagacgacgaggttgccgtcctgctgcatcgtcatacggatgcggttggtggcccaggactggccgaccccgatggaactggtggcggagaccgtctgggtgccccagttcggcttcgggacagccttgggcttcggtttcggtgaggccttcggcttctcggcgggggcgctcgtccggggtgcgggcgtgggtaccacgggtgcgggaacggccttcggcgcggcggacttcttctgcttcgtcggggacggcgtgggcttcaccgccacgtagtcgtccagggccgccggggccgattcggcgttgaggacggtgtcgccgctcccggcgaccggtgccgtaccggtgttacgcggcttctcgtcgttcgcgctgcccatcagcagcacgggtatcgcgaccagggcggcgccgacgaacacggctcccgccaggaccggtgtgcgggggcggcccctgtcggcaacggtgagggtccgggtcaccggcttcgcggcgacggccgtcgccagtgcgatgccctccgtgcggccctcgggtggatcggtggtcccgcccgtcgacgggtcggacggggcggcggccgtcgggggagccgcggcccctgccgcggctgcggccggagcccgcgtctcctcggtcccggtcgtggcggcggcttcggtccgggtcttcccggtcccggccgtggcttcggccggtgccggggactcctcggtcccggtc

SEQ ID NO: 4204 - DNA, 1290 bp, Unknown
  Kingdom: Bacteria, Phylum: Actinobacteria, Class: Actinobacteria, Order: Streptomycetales, Family: Streptomycetaceae, Genus: Streptomyces
  misc_feature (668)..(719): n is a, c, g, or t
gcccggcgggccctcgcgcgagaccacgttcatcggcggcacgtacatgcagcacccgctgtcgatggcggcggcccgcgcggtgctcacccacctcaccgagcggggtcccgggctccagagcgggctgaacgctcgcacccaggcgctcgcggaccggctcaacgcgttcttccgcgacgaggaattccccctggaactggcccacttcgggtcgatgttccgcttcaagcaccgcgccgacctggagttgctctatcaccacctccaactgcgcggcgtttacgtatgggagtggcgcagcttctacctctccaccgcccacacccaggaggacgtgaaccgggtcgcggaggcggtggagggctcgctgcgggagctgcgcgacggcgggttcttcccccggtccgcccgcccggcagccgtgcggcgggccggagtacggcggtccgcacccgacttcggcgtctacttcttcggcgactacccggagaccggcgaggccggcggaagcggcggtggcagcggcaccccggaggcgtacgacaccgtcctggagaccgcgcgcttcgccgacgagcacggcttctcctccgtctggctgcccgagcggcatttcgactccttcggcgggatcttcccgaaccccgccgtgctcgccgccgccnnnnnnnnnnnnnnnnnnnnnnnnnnnnnnnnnnnnnnnnnnnnnnnnnnnngccgtgctcgccgccgccgtggcccgggagaccgggaacgtccggatcaacgcgggctcggtggtgctgccgctgcacgatccggtacgggtcgccgaggagtggtcggtcgtggacaacctctccggcggccgggccggcatcggctgcgccaccggctggcacgcccgggacttcgccctgcacccggaccggttcgccgaccggcggcggatcgccttcgaccacctcgacgaggtgcgccggctgtggcgcggggaggcggtgcggcggcgcacgggcgagggcgcggaggcggagatccggatccggccgcgcccggtgcaggaggagccgccgttcttcctggccacctccggacagcgggcgtcgtacgaggaggcggcccggcacggcctcggggtcgtcaccaacctgatgagccagagcgtggacgagctggccgcgaacatcgcgcactaccggcgtacgcgcgcggagtgcggtctcgacccggcggccgggcgggtgacggtgctggtgcacacgtatctcggcgacgaccacgccaccgcccgggccgaggcgctgg

SEQ ID NO: 4205 - DNA, 3521 bp, Unknown
  Kingdom: Bacteria, Phylum: Actinobacteria, Class: Actinobacteria, Order: Streptomycetales, Family: Streptomycetaceae, Genus: Streptomyces
tcgacctcgccgccgcgctggcgggcgacccccggctgctgctcctggacgagccggcggcgggactgaccgacgacgacatcggccggctgctcggcatcctcggcggtctgccgtcgagcgtcgcggtcatcctggtcgagcaccatgtcgaggtggtcgcccaactcgcttcgacggtaacggtgttgactgccgggaaagtgctcgtcaccggcccgacccaggaggttctggcgcaccccgaggtccgcgaggcgtaccacggcaccggctccccgggggcgggccgggccgccgacccgtccgccgcaccagcgagaggatgaccgacacacgatgctcgaactcaccggcctgaccgcgggctaccacggcggcaccgtcctccacgggctcgacctgtcggtgtccgccggcacggtccacgccgtcgtcggccacaacggcgcgggcaagaccaccctcgtccacaccgtcgccggactgatgcgcccgagcgccggaaccgtacgcctcgacggccgcgaggtcacgggacagcccgcacaccggatcgcccgtgccgggatcgggctcgtaccgcagggccgccgggtgttcgccgggctcaccgtcgatgagcacctgcggctgtcccaccgtccgccgcgccggggcgacacggaccggcccagcgtgtggacacccgcgcgggtgacggaactgttgccccggctgggcgagcgccggggcaaccggggtgcggatctgtccggcggcgagcagcagatgctggcgctggcccgcgcgctgctcggttcgccgcgtgtactgctgctcgacgagccgaccgagggcctggcgccggtgctcgtccggcaggtccacgagctggtggccacgctggcggccgagggcatcgccgtactgctggtgtcccccagcccggcccaggccgtcgagtccgccggggcgctcacggtcctcacctcgggacggacgacgctgcgcatggacggtgcggaagcccgcgccgacggcaccgctctgcacgcggcgctggagctggcgccgacggcggtctgatacaccaacggcaggggcggcgacccgtacgcgggggccgcccctcccgccgcgtgcgccttcagccgcgcgcgccttccgctcagggaggcttacccggccttcatgctgtgaccgccgaagccgctgcgccggtcggaacccttgttctggtcctgccaccacgcgtcgaacccggcccggcccatggcggaccagtcgggtgtgttctcgacctgcgcggcgcccatccggcgggcgagcgcgaccatggccgacccgacgggaccgcgccccgcgtcgtagctctccaggacctccttccaactgcccccggccgtccaggcggcctccagagcgctggcgtcctggagcgccttcacgctgccgccgccgatgtgcggccgggcgacactggccgcgtcgccgacgagcaccatccgtcccgaggtgtagtgcggcacctccaggtcgtagatgggctggatgaaggtggtctcggcgggggtacggagcaccctggccgcccagtacgacgggaagttgtccgcgaccagggccctcaggtgcgcggtgtagagcacccagttgagcacgtgtccgccgacaccgtccgggatgcggtagatcatgcagtgaccgccggggaagacgatgttgtgcgcgtcgtggccgtccgacgggaggtccgcgacgtccggcgacgtcccgcgccatccgatgtatccggcgtacgtggcgtccgcgccggggaacatggcctcgcggacgactgagcggtagccgtccgccccgatcacgaggtcgaagtgctcctgctgcccgtccgcgagccgcagcgtcaccccgtcggcgtccggctccaccccggtgaccaccgccccggaccggtaggagacctcctcgggcacccggcggcgcagttcgctccacagggacccccagctgtaggcgcggaaggggaacggctgctcaccgacgacccggccgtgatcggcgtcgccgtcccgcacgctccacacccgccgggtcagcggcgcccagggcatctccggagcgacgtacccggcctccctcaactcgtcgtagcggtcgctgtggagggcgattcccacccctctgtcacggagccgggcatcggcgcgttccaggacggtgatccgctcggctcccccgcgcgacgcggccagggccgcggcacaccccgctatgctgccgccgaccacggcgacgctgcctccacgcatgtctggcactccactcactcgacgctccagccttccggtcccgcccacccgacacgctccgacggccgccgcggacgccgctgtcgtggcctgggggcctggcgggatgggcggggcagtggcacgcttgggcgaaatcaccctgtatcaagggttgttgaccagcgatagggcggtcgggacccgcacgggatcctatcggggcatccggtggaccggcggcgcacgcatgtcggacggtgggcgcgcgttcagcccttccggaacgccgcgtccaggttggggatctcgacggaggagtgcagggtgaccccgtcgaccggcttgacccgggtggcgatcagagcgagtacggcgtccgcgaggcggatcttggtcgcgtcggtgcggccgtggagcagcctgatctcgatgtgcaggaccgcgtggccttcagcctcaccgccgatgacgaagtcctccacctggcggaagcgggtcttgcaggcctccgggcgggtgtcgacggtggtggcgatgagcgggtgcagggcgagtgcgaaggcctggcggtcgaaggcctcggcgagcgtgccggagtagtcgacggtgatctgcggcatgggaggcaactcctcggaggacagcgtgggctggagaacgtccgctcgtacggagggaacggtatccgaacgtacgtccaggtcgggggtccgtccgccgtcccggtcgacgcacgctccggtcggccccgcccgcgctgcgcaccggggcggtcggccttaccgtctgtgctgacgtcgtcacccagggagccggtcggcgcggacgcccgcacccggcgcggcggctgtccccactcccgtacaggaggagcccatgccggagctgttcatcgatggtcagtggaccgctgccgccgaggggcggacgcgggagatccgctgtcccgccgacggcacgctggtggccaccgtcgacgagggcggggccgaccggagcgtgcgtcgaccgggacggcggacggacccccgacctggacgtacgttcggataccgttccctccgtacgagcggacgttctccagcccacgctgtcctccgaggagttgcctcccatgccgcagatcaccgtcgactactccggcacgctcgccgaggccttcgaccgccaggccttcgcactcgccctgcacccgctcatcgccaccaccgtcgacacccgcccggaggcctgcaagacccgctt

SEQ ID NO: 4206 - DNA, 1410 bp, Unknown
  Kingdom: Bacteria, Phylum: Actinobacteria, Class: Actinobacteria, Order: Streptomycetales, Family: Streptomycetaceae, Genus: Streptomyces
gctcgcccagagcgcggcggccaccacgaccgccgcgctctgggcgagcatggtcgcggtcgttctcggcgccgccgcagccctcgtcatcggggtggtcgtctatcaggaactgtcgtcgggcgatccgacgtacacctcctccacctccacgtcggacctgccctcgtcctcgccctcgccctcggcggcctccgacgaactcgcgggggtctggcgggacgcggaggggaacgtcttcctgatcgtcaggtcgggtggcggggggtacgagttcaagagtcaggggacctgtggtgccaccagcaccgtgaaggtcacgggcggatccggcagctacagcggcacgatgccggtgtgggacgagtcgacctgtggaaagaccttcggggacgcgcggttgtcgatcgacgtctcctccgacggttccagcgcctccgtcgaggtgacggcgccctccgacggaagctgggagtgccggaactgcggatcccagacgtgggctcgccagtcctgatggacgacgacggccgcccgccgcacgggccgacacgaaggaagccggccgcgccggccgaaccgagggagaactccatgccgccttccaccggcgaccagtacacgatcagcatcggtggtgacgcctcgggcaccgtggtggcgggccacggcaaccaggtcgaggtccaccgaaccggcgaagccgaacccgacgcccctgccggcgcgagcaccgacgcgagcaccgacgccgcggcgacccagaggaccaccgtccgggaccacggcaccgcctacaccgtcatgaggggggagctgaacatccaccacgcggcccccggccggtcaccggaaccggaggaggactgaccgaggaggactgaccgaggagggccggcctaggaccggccgctacgcgaagcactccaggatcagcggcaggtcctccagccactcctggaggcggccccgcctccgggcggcgaggaggcacgggtgggccgtgccgcggtgcgggtggacgacgaccttgaggtgcttgggtccctcggccgcgtaggtcacggtgctgatctcggcccaggagtagtgcgcctccgcgccctccggtcccagcgtgacgccctcggcgtcgatcaggagggaacctcccgggccgaccgccacgaacgtgaggtcggcgtcgtccggtgcaccgcccgcgaggacggtgggggccccgtgcggcaggagggcgttggacggcgcgtacgacggcggcggcgggagcaccggcacggtgggggcgtacgccgcggcgggagcgtgctgcacggcgtccggtacgaacagatccagcaggcccgccggcgtgggccgctcccccgggaccttggccaggcacgccgcgaggaccggccgcagcgcctc

SEQ ID NO: 4207 - DNA, 2622 bp, Unknown
  Kingdom: Bacteria, Phylum: Actinobacteria, Class: Actinobacteria, Order: Streptomycetales, Family: Streptomycetaceae, Genus: Streptomyces
cgtacgccgggccggggggcgtacggcctacaggtgcgtcggctcgaacatccgcagcagcgccgggagcacgacgaccgacggccccggggccgccagcgccttgcccagatcggcggcgagggagtccggtgtcgtccggacggcggggacgccgaaggactcggcgagcgcgacgaagtccgggcgggccagctcggtggcggtggcctcgccgaaggctccggtcatgtactcgcgcaggatgccgtaaccgccgtcgtcgatgatcagccaggtcagcggcaggccgtactggcgggcggtggccagctccgcgatggagtacatcgcgccgccgtcgccggagaccgccagcacgggcttcgtcgggtcggcggcggccgcgccgatggccgccgggaagccgtagccgaggcctcccgcgccctgggcggagtgcatggtgttggggtggcgggcgtcgaacgcggaccaggcccagtacgccaggatcgtcatgtcccagaagctgggcgccgcgtcgggcagcgcctcgcggacggcggcgaggacctgctgctccagggtgaggtcctgggcgtcgatccggacccgtaccttctccagcaccgtacgtacgcgctcggcggctcccgcgtcctcgcgccgctcgacggcctccaggaggtcggacaaagcctcgcgggcgtcggagtggatgccgagggcggggtggttggactccagcttcccggcgtccgcctcgatctggatcacccggccgcgcgggcggaaggtgtggtagttcgaggagagttcgccgagccccgaaccgacgacgaggaggacgtccgcgtcctccaggaagtcggtggtgtgccggtcctccagccaggagcgcagcgacagcggatgctcccaggggaacgcgcccttgccgccgaaggtggtgacgacgggggcgtcgatcctctcggccagcgcgaggagcttgccggaggcgtcggagcggacgactccgccgcccgcgatgatcacgggccgctcggcgttcgacagcagatgggccgcagcgatcgtcagctcgggtcgcgggtggagctcgcgcggggtggcgtccatggcgctgacgaccggcagggacgtctccgccagcagcacgtcctgcgggatctccacccagaccggcccgtgcggggcggtcagcgcggactcccaggcggcggcgacggcggagggaatctgggaagcgctgcgcacggtgtggacggacttcacgatgtcgcggacggaggcctgctggtcgcgcagctcgtggagatagccgtgccgcccgccgccgagcccggccgtggggatctggctggagatcgcgaggacgggtgcggaggcggcggcagcctcctggagcgcggcgagcgaggtgagcgcgccgggcccggtggagagcagcaggggcgccacctcaccggtgatccggccgtacgcgtcggcggcgaagcccgcgttgttctcgacacggagtccgacgtacgagagggaggaacggcgcagcgcgtcgaacatgccgagcgcgtgctggccgggcagtccgaagacggtggtcgcgccgagcccctggagggactcgacgacgaggtcaccgccgttgcggccggccggcggattcagtacggcggcggcctgggcggcggtgagctgcggccggtcgtcgtggtcgtggctcacttggccgcaccctccttcgtctccttctccgccgcgatctgacgggacatgatcgtcgtcagctcgtacgcggcgtgcgaggcggccaccgaggtgatctcggcgtggtcgtacgcgggggcgacctcgaccaggtcggcggagaccaggtggcaggaggagagcccgcgcaggatctccagcagctcgcgggaggtgaggccaccggcctcgggggtgccggtgccgggggcgtgcgccgggtccaggacgtcgatgtcgatggagatgtagagcggccggtcgccgatgcgctgccgcagctggtcggcgatctcgtcgacgccgcgccgcatgacgtcggcggaggtgacgatgccgaagcccatcttctcgtcgtcggtcaggtcctgcttgccgtacagcgggccgcgggtgccgacgtgggagagggcggaggtgtcgaggatgccttcctcgaccgcccggcggaacggggtgccgtgggtgtactcggcgccgaagtaggtgtcccaggtgtccaggtgcgcgtcgaagtggagcagggcgacgggcccgtgcttcttggcgacggagcgcaggagcggcagggcgatggtgtggtcgccgccgagcgtcatcaggcgtgcgccggtgcccagcaggtcgtcggccgcgccctcgatggtctcgacggcctcgttgatgttgaacgggttcgccgcgatgtccccggcgtcggcgacctgcgcgagggcgaacggggaggcgtcctgcgccgggttgtacggacgcagcagccgggacgcctcacggatcgcgttgccgccgaagcgggcgccgggccggtaggagaccccggtgtcgaagggcacgccgaccacggcgacgtcggtccggccgacctcgtcgagccggggcagccgggcgaac

SEQ ID NO: 4208 - DNA, 3425 bp, Unknown
  Kingdom: Bacteria, Phylum: Actinobacteria, Class: Actinobacteria, Order: Streptomycetales, Family: Streptomycetaceae, Genus: Streptomyces
acgctgcacctgctgcgcgccgcgaaggcgtccgccgcgctcagcgggcgcgactacgccctgccggacgacgtccaggcgctggccacgccggtgctcgcgcaccggctgctgcccaccgcccaggcccagctgaaccgccgcacggcggagcaggtggtcctggagatcatccagcgcacccccgtaccgacctcggccggcggcaccgcaccgcccgcaccgggcgggcaggagccgggccgaccgctgtaccaccagcagcagcccggggcacggcggctgtgatggcggccggcgagcccggcgccgtggaggacggcgacaggaagggcggcctccgggcggccctgggcggactgaccacccgggggcgctcgttcctcgccgccgggcttgccgccgccgtctgcgcgtacgtcctgggccagggcgatctgctgcgggtcgggctgctgctggccgtgctccccctggtctgcgtgaccgtgctctaccgcacccgctaccgggtgacgggcacccgacggctctcaccgtcccgggtgcccgccggcgcggaggcccgggtgcatctgcggatggagaacgtctcccggcttcccaccggtctgctgatgctccaggaccgtgttccgtacgtcctcggcccgcgcccccgcttcgtcctggaccgggtggaggcgggcggcaggcgcgaggtgtcctaccgggtccgctccgacctgcgcggccgctatccgctgggcccgttgcagctgcggctcagcgacccgttcgggatgtgcgagctgtcccgctccttcagcgcgtacgacaccctcgtcgtcatcccgcgcacggtgccgctgcccgtgctgcggctggcgggcgaagcctccggatacggcgacgggcggcagcggtccctcgcgctggccggtgaggacgacatcattccgcgcggctaccggcacggcgacgacctgcgccgggtccactggcgctccaccgctcgccacggcgagctgatggtgcgccgtgaggagcagccgcagcgagccagatgcacggtcctgctggacacccggggaatcggctaccagggcgccgggcccgactcggcgttcgaatgggcggtctccggagcggcctccgcgctcgtgcacatgctggagcgcggcttcgccgtacggctgctcacggacgacgggaacgcggtgcccggggagggatcgggcggtttcgcgggctcgacccaggagtccgcggactcggccggcctgatgctcgacacgctcgcggtcgtcggccattccgacggcgggggcctctcgcgcgcccatgacgtactgcgcggcggcaacgaggggctgctcatcgccttcttcggcgatctggacgaggagcaggccgcggtcgcggcccggatgcggcagcgggccggggccggggtcgccttcgtcctggacagcgccgcctgggccggcgacgagggcgaggcgggtcgggccgaggagcggctgcgacggctgcgcgagtcgggctggatcgcggtgcccgtggagccgggcgccgaactgcccgcgctgtggcagctggcgggcggaatgcgcacggattcgccgtcggccccgagcggcggcgcgacaggtttcacggggggatggtcatgagcgggcgggccagactggcgctgtgcgcctatgcggcgacactgctgacggcgggggcgctgatcccgctggtggagggggtcggctggctggtgcaggcggcggtgctgctcggcgtccagagcggggtgggtgccctcgcgcgccgggtcccgctggccaggacgctgaccatcgccgtccagacgctggtcactttgctgctgctgacgctggtgttcgtccgggaccacgccctgttcggggtgcttcccggaccagaggccctcatgcggctcggcgagctgctggtggcgggcggggaggatgtcggcacgtacgccatcccggccccgatgaccgacggcatcaagctgatggtggtcggcggggtggtcctgatcggtcttgcggtggacgccctggcggtgaccttccgcagcgcggccccggccggactgcctctcctcgccctgtattcggtcgcggccggtctttccgacggcggagcgagctggctgtggttcctgctggcggcctccggctatctgctgctcctgctggcggagggccgggaccggctctcccagtggggccgcgtcttcggcggcgccacgcggaatccgggcggcctggccgacggtcttgccggggcggccggcggctcctcccccgtccggaccgggcggcggatcggtgtgctggcgctcggcatcgccctggtggctcccctggccctgcccgccctggacagcggcctgctggggggcaagggcccggggaacggcaggggcagcggcggcggcaccatctccgcggtgaatccgctggtctcgctccagaacaacctcaaccagccggacaaccgggaggtgatgacatatcgcagcaacatcgagaacccgcagagcctctatctccggatcctggctctggacgagttcaacggcagcgagtggcgatcctccacccgccggctgacggacgttcccgaccgcctcccgcagcccaccgggctgggccgggacgtctccgtcaccgaggtccggacgaacatctccgcatcgcgctcctaccagcagacctacctgccgctcccctacccggccagcgaggtccgcgtcggcggccgctggcggtacgagcccgagggccgcaccctggtcggcgacgacgggcagaccacacgcggcgcgcggtacgaggtcggcagtctggtcgtcgaacccacggcggagcagctcgcggccgccggtccgccgccggaggagctcgtccgcgagtacacccaggttcccggctcgctgccgggcgtggtcgccgagaccgccgagcaggtcaccgaaggctcgtccaacgcctacgagcaggccgtgaagctccaggactggttcgcgtccgacggcggcttcacgtacgacacgacggtcacctcggggacgggatcgtccgccatcgcccggttcctccgcgaccgggagggcttctgcatccacttctccttctcgatggccgcgatggcccggacgctgggcatcccggcccgggtagcggtgggcttcaccccgggcaccatgaaggcggacggggcgatctcggtcgggctgcgcgacgcgcacgcctggcccgagctgtatttcgagggggtcgggtggacccgcttcgagcccaccccgagccggggcagtactccctcgtggacccggcccgaggtccccacggacagcgcgagcgacgtggcccagccctccgcggacacctccgccgaaccgtccgcggagggctgggcca

SEQ ID NO: 4209 - DNA, 626 bp, Unknown
  Kingdom: Bacteria, Phylum: Actinobacteria, Class: Actinobacteria, Order: Streptomycetales, Family: Streptomycetaceae, Genus: Streptomyces
ggccggggccgacggcgtaccgggagccggagccgctcagtcgccgagcacgcgccgcaggtagtcgttgccgaacaggcggtccgggtccagtcggtcgcgcagcgcggtgaactcgccgaagcgcgggtagacctccgccagataggccgcgtcgcgggtgtggatcttgccccagtgcggccgaccggcgtgcgcggtcatgatccgctcgaccgcggtgaagtacgaccggtggggtgtgcccttgtagagatgtacggcgatgtacgcgctgtcccggcccgaggcggtcgacagtgccatgtcgtcggccggagcggtgcgcacctcgaccgggaagctgatcttcagcggtgaccgctcgaccatggccttcagctcccgcagcaccgtcaccgcccgctcgcgcgggaccgcgtactccatctccacgaaccgcacgcggcgcgggctggtgaacaccttgtaggggatgtcggtgtacgtacgcgccgacagcgcccggctggagatcctggagatcgaggggatcgtcgccgggaccgcgcggccgagcgaacaggcgacctggaagacgccgttggacagcagttcgtcgtcgatccagctgctcaccctcccgg

SEQ ID NO: 4210 - DNA, 1338 bp, Unknown
  Kingdom: Bacteria, Phylum: Actinobacteria, Class: Actinobacteria, Order: Streptomycetales, Family: Streptomycetaceae, Genus: Streptomyces
gctcggacggctcggacggcgacagcctcttcgggccgccggtgcctgtgccgggcgacgctccgctgctggaccgggtgatcgccctcagcggccgccacccggactggcagccgggcagctgagagggagaggttccgccacctcacctcccgggacgcaccgctcggttttcttcaggttcctctctcaccgaaaagtgcgttcttcccgttcaacacccagctcgcctacggttttcgcagacccgacgagacggctgggagcgccctcatgaccattctcaagacgtacgcacgcctgtgggccgacgacctcgaccaggcgctgccgctgttggaggagctcaccggcgaacggccccatctgcggatggcgttccaggagatcgccctcgccgccatcggcgatttcctggtcatcgcgggtccggccgaggagcgcgcccggtacgaccatgcatcggcgaccgtcgtcgtggacgacctggaggccctgcaagccacgctgaagtccgccgaggccacgatcaccactcccgcgaccggcggtccgacgggacggttcctctatgcccgccacgcaggcggagcggagatcgaatacgtcgagtggacgccggatctggtccgcaggatcatcgtctcgtgatcattcacccctgatcgttcgctcctgatcattcgcccctgatcattcgcccctgatcattcgcccctgatctgcgcccttggtcattccctcctgaccgccgccctcacccgggcgcgcagccgttcgtcggcgacctcgaccgtcccgtccagcccggacctcaccactcttctgtcccgctcccccaactccgtgagccgcgtccggtgctcgtcggacagcgcgtccgtgccgaacgccaccagcgcgtccacggcctcgaagggggctgcgcccgcttccgccgcgtcgagcagaagaccggccacgtacccggagtccagctcgtcgggggcgacggcacggagggcgagggcagccgacggcgcctgccgggggtcggcgagcaacgccttcagtgcggggacgagcggtcgggccgccgggccgaggctccccgcggccgtcgccgcgcgggccagtgtccagcgccgccagagcccgtcgcggtcaccgagcactccggccagcacgggcaccgtctccgtcgcgtcgccggtgatccggtgcagggcgacggcgagggcgatgtcgtcgtccatctgcgggttgttccgctcggctccggggctgttgagtgcggcgcgcagtgcgggtacgagcgacccggcggcgggtccgacagcggcggcggcctccgccgcc

SEQ ID NO: 4211 - DNA, 2493 bp, Unknown
  Kingdom: Bacteria, Phylum: Actinobacteria, Class: Actinobacteria, Order: Streptomycetales, Family: Streptomycetaceae, Genus: Streptomyces
aggcacacctgtccgccgggcggcccggggcggcacgggcgctgctcgccggactgccgggggagatccgtgagcgcggacgtttccggctgctgctcgcccggacgctggtcgccgagggcgacaccggggcggcccgggagatcttcgacgccgggttcgaggtcgccgacctgcgcgaaggggccggaatcctcggcgagctgtgggcgtccgtcagcgacgagccgctgccggacgcctacgacttccgcatgagcccgcccgaggggtgacctgaccggcgcgccccgggcggccggtcagacggtgacgttgcggtccacgtactcgaagaccgagccgtccgggtgcagcgcgatgaggttgcggcccgccggggtcggcaccggccccgcgatgacccgcgcacccgcccgggtcagcgcggcgttcgcctcgtcgacgtccttgacggcgatggtcgcgcccaccttgcgcagcacctccagctccgactcgggcccgctcatcaacaggaagcagccgatcgcggccaccgacaccccaccgcgctcgaagcgcagggccgacgtacccgtcagcccctcgtagaaggccaccgaggcctccaggtcgtcgacgcagatacgcagcgtggttccgaggatctccatgcgtacgagggtagttggcggccaccgccggtgtgatcgattccgtgcgggagggaacccctctccacctcacgccggcctctcctcacctcacgcccggcacagcacctcgccgtgcgggaccatgaaccagccgtcgccctcctcgccccaggcgcgccacgccccggcgatggccgcgagccgctcggcgctcgcatgcccgccccgtacggccagctcggcgtagaccgagtccgtcgtgcggtccgcccacaggccgctccaccaggcgcggctctccggggtggcgaagcaccaggcggccgcggtgggggtgatgtcggtgaacccggcgcgccgcgcccaggagaggagcctgcggccggcgtcgggctcgccgccgttgccgcgggccacccggccgtacacctcctgccaatcgccgagaccgggggcctccgggtaccaggtcatcgccgagtagtcgctgtcgcgcgccgcgaccacgccgccggggcggcagacccgccgcatctcgcgcagcgcctggaccgggtcgcccacgtgctggagcacctgatgggcgtggaccacgtcgaacgagtcgtcggggaagtccagggcgtggacgtcggccaccgcgaactcgacgttctccaggccgcgttcggcggccaccgcggcagcctggccgagaatgtcaccggtggtgtccaccgcggtgacccggcccggcgcgaccagagcggccaggtcggcggtgatcgttccgggcccgcagccgacgtccagcacggccaggccggggcggagttcgccgaggagatacgccgccgagttggcggcggtccgccagcggtgcgagcgcaggaccgactcgtggtggccgtgcgtgtacacggcggtctccttcggcatggcgttgcgtcctctcccgaaaacctcgcgccgacgggcgcggcgacaggaaccaccgtacgccgccgggccgaatggtgagataggcgtcttgggatacggacagttcctgggtggcgtccagggagttcaggccggcaacgggcagtagacggtcagcgcctccggaagcttgtcgatcgtcagttccgttccggagtgggccacttccccgtcgtacgcgtacggcgtccccggtgcgaggtctccgatccgtacccggcggcgccggaccgcggcatgggcgggggagcgggtcagcggtcccgccaccgccgctgccagcaggcgcaacccgggcgtccggccgccgtgcaccacccggacgtccagcagcccgtccgccaggttgtgccgacggcccggggccgggcccacccgttggaagagtccgttgccgacgaaaagcagccacaacggccgcctgcgaccctggagttcggcctccagcggtcgccggccgcgcagcacgtggaacgccgcgagcacgccggccggccagccgccgatccgaggcgaccagtgttcccgggtgcgcaccagttccggatagacgcccagcgagaaggcgttgaggaaatacccgtccgccccctcctcgcccgcgggtcccggacggaagcggccgaggtccacccggatggcatcgcccgcggtgagggcggcggcggtgtcgtggacggtctctatgcccaggtcgtaggcgaagtggttgagcgtgccgccggggaagaccgccagcggcatcccgtgcgtcgccgccacggaggccgcccgattcaccgtgccgtcgcccccgcagacgcccagcgcccggccccggcccgccgccttctccaacgcggccgacagctcctccgggggcacctccaccacctccgccgcgggcagcgcctcg

SEQ ID NO: 4212 - DNA, 567 bp, Unknown
  Kingdom: Bacteria, Phylum: Actinobacteria, Class: Actinobacteria, Order: Streptomycetales, Family: Streptomycetaceae, Genus: Streptomyces
ccgcccccggggtcagtgggtgccggcggtggtcttctccggggtgcgcgactggagcgcccggtaggagacgaagaggatgagcgcccacagcggtgcgcagtagagcgagatcctggcgtccttgtcgatcgccatcatcacgatgaccatgccgatgaacaggagcgcgaaccagctcgtgtacggggctccgggggccttgaacgaggactgcggcagcaggcccgcgtcggccatgcggcggtagcggatctggctgaccaggatcatgatccaggcccacatgccggagatggtggcgaaggagacgacgtagttgaacgcctcgcccggccactggtagttgatccccacgccgacgagcatcagggcggcggagaaggtggtgcccacgagcggcaggccgttcttcgtcagcttggtgaaggcgcgggggccctggccgttgagggcgaggtcgcggagcatgcggccggtggagtacatgccggagttgcaggaggagagcgccgcggtgaggacgacgaagttgacgatggcggcgccgacgctgaaccccatctc

SEQ ID NO: 4213 - DNA, 1859 bp, Unknown
  Kingdom: Bacteria, Phylum: Actinobacteria, Class: Actinobacteria, Order: Streptomycetales, Family: Streptomycetaceae, Genus: Streptomyces
cccccggcgccagggctccggtgggcggcgtccgcgagcggtacggcctgcgcgggcggcccgtgaccctctgcgcggcgcggctcgtcccgcgcaagggccaggacaccctgatccgcgccctgctcgccgtgcggcgcgcggttcccgacgccgtggtcgacgggcgcgccgtcgcggaccggctcgtcggcctggtgacggaccgggtggcggcccgcgcgatgggggagaagggccgggcgtgggtccgcgaggcgcgggggtgggagggggcgtacgacacccgcgcgggactgctgaccccctgaccggcgtggcaggggggcgtcgggccgggcaagctggaggcggacaatcccgcggccggccatccggccccgcgggacggccggatcggacaaggaccgtgatcatgaccggtggcacccgcgagggcatcgacctcacccgcgtcctgcacgcccctcagcagcgcgtcttcgccgcctggacctcgccggaggacttcgccgcctggtacgggggagaggcggacgtccccctggaccgggtggcgatggacgtacggcccggcggcgcgtggagcctggtcatcgtgatgccgggagtggagatgccctttcacggggtctaccgcgaggtgagcgagcccgacggtctcgtcctcacgctcaaggacgcctccgcgcccgaggacgccgagggtgagatcgtcaccgtcaccttcagcgacctcggcgacgggaccaccgagctggccttccagcagcgcggcggcaacctgacacccgagcagtacgcggcggcggaggacggctgggaggccttcttcgacgccctggccgcccgcctcgccacccatccctgagcctcccggggcttccgtccccgtaccccggcgactcccgccggttcaccgcgtcagcggaagcgccgccaactgcgcgatcacccacgtcagcggggcgaacagggccagcagcgcgcccgcccgcagcgccgtcgcccggcgcagcgtggcggccggagcgcccatcctgagcagcgcctcgaccgtgtgggcgcgggcgtgcttggcctccagcgccgaggtcagcagcgtcgccgtcgtacagccgaggaccagcaccgcgccgagtgcggtgagcgggccgtacgggcgctcgtcgcccccgtacaacgccgaagcggcgatcgccgcggacagcaccgcgcagacgaccccgagcgggcggccgatccggtgcgcctcgttcatcaggacccgccccgccagcagccgtacggccccggggcgcaccgcctgcagcgcccgcccgcacagatacgtcaggctcggtccggccatcgccaggccgaccgctgtgagcgaccacccgatcaggaccgccaccggggtggagtcgtaccgtccgggcagcgggaacgcgctccccgccgcaccccgtgacgcgatcgcctcgaccgcgagtccggcagccgtcagggccacgccccaggggagcccggccggagccggtgcgggctccggcaactcctcggagccgaaggcgtcccgggccgggtcgggacgcgaccgcagcgccagcgcgctcgccgtcgacgcggccaccggtacgagcgtcagcagcatcagcgcggcggccggcggcagcggactgcccgcgccgaggaactccgcggcatccccgtcgaacggcatcccggtgagatcgccgcgcagatgcaggaagaagagcagggccaccacggagccgagcgtggtggagacggccgtcgagaccgcggccagcgcggacagccggaccgggccgaggcccacggaggagaggcccggccggctgtccgcgctggcc

SEQ ID NO: 4214 - DNA, 794 bp, Unknown
  Kingdom: Bacteria, Phylum: Actinobacteria, Class: Actinobacteria, Order: Streptomycetales, Family: Streptomycetaceae, Genus: Streptomyces
gcgcgcccagatcgtcggcgcccgtcgcaccgcggaggagctgggccgggccttccccgccgtgcccgtccgcacctcggggcgcgaccacatcctggacgcggtgcccgacgctcccgccctggtcgtctccacccccggcgcggaacccgtcgccgacggcggatacgcggcggccctgctcctggacggctgggccatgctcggcaggcccgatctgcgggcgggcgaggaggcgctgcgccggtggacggcggcgggcgcgctggtccggggccaggacgagggcggcacggtggtggtagtggccgagccgacggagcgtgcggtgcaggcgctggttcgctgggacccggcgggattcgcccggcgggagttggcggagcgggccgagctgggcttcccgccggtgtcccggatggcctcggcgaccggtcccgccgatgccctggccgcgttcctccggacagccgggctgccgccggagtccgagatcctgggtccggtgccggtaccgtcggccgagccgggcaggccccgccgaccgggggacgccccgccgggagagacctgggagcgggccctgatccgggtcgtcccaggacgtggggcggcgctcgcccgcgctctgaagacggcgctcgcggcccgcatggccaagggggcgaccgacccggtccgcatcaggatcgacccgcccgacatcggctgaggcccctgcggcagcctgtgggtccgggcaggggactgccccgccgtgccgaccggcacggtggggcagtcccctgcccgga

SEQ ID NO: 4215 - DNA, 500 bp, Unknown
  Kingdom: Bacteria, Phylum: Actinobacteria, Class: Actinobacteria, Order: Streptomycetales, Family: Streptomycetaceae, Genus: Streptomyces
gatggtgtcctcccgccgcgtccgcgccaggccctggaggtggccgcggcgggaggacaccatctgctgttctcgggcccgccgggcgcgggcaagaccatgctggccgagcggctgtcgtcggtcctgccgccgctgacccggcaggaatccctcgaagtgacggcggtccattccgtggcgggcatcctccccccgggtgaaccgctcgtctcccgggcgccgtactgcgccccgcaccactcggcgaccatgcagtccctggtcggcgggggcaacgggatgccgaggcccggggcggtctccctcgcccaccgcggggtgcttttcctggacgaggcccccgagttctcgggcaaggccctcgacgcgctgcggcagccactggagtcgggtcatgtggtggtcgcgcgggccgcgggggtggtgcggctgccggcccgcttcctgatggtgctggcggccaatccgtgtccctgcggccggcacactctcaccgg

SEQ ID NO: 4216 - DNA, 1462 bp, Unknown
  Kingdom: Bacteria, Phylum: Actinobacteria, Class: Actinobacteria, Order: Streptomycetales, Family: Streptomycetaceae, Genus: Streptomyces
gcggcgacctgtacgccgtcgcggacaccccgtacggcgtacgtgtggtggtcggcgacgtacgcggcaagggactgggcgccgtcgaggcggtggcggtgatcatcggagcgtttcgggaggcggccgagcaggagcgttcgctggagggcgtcgcgcaacggctggagcgggcgttggcccgggaggggacgcggcggtacgggctggacgccatggaggggttcatcaccgcggtgctggccgagatcccgcccggttcggcctcgttgcgcctcgtcaaccgcggccaccccgagccgatcctgctgcacgccgacggagccctggaggtgctggcgccctcggtgcccgcgctgcccctggggatggacctgggggtgtggccggaccggtcggacgagtgggcgatgcccgccggggcaacgctcctcgccttcacggacggcctgtccgaggcccgggacccgaacggggtcttctatgacccggcggcccggctgcgcggccggatcttcccgggcccggaggagctgctgtcggcgctgacggacgacgtccggctgcacaccggcgggcggaccacggacgacatggcgctcatcgcggtcggccggccggcggaggggcagccggtgcgccggacgacggtgaagatcgtgggccggggcgacgacgccgggcgatgacacggtgcgtgaccgaagagcaccgctccgcataacatttgacacaccgtcagaaaaagtggtgtggctgagccgtggtcaagtcgcccgattccccccgcttatgacccgtacgtccccacggagttcgttaatgatcaacaggaacagcttggaatagggcccgcctgtctattaacgttcgataacgcagcgcggtcgcacagccgtcgtcagagacggcaccgcgcgcgagcgccgaattccgcaagggaaccggggaaccacctacatggggtgaatcggacgcctgcgtctcgtgagagacggaggggcccgtaggagaccttcctgctccgaacccgtcagctaacccggtaggcgagaaggaaggaaaggagtgcgcccacgtggcgtccaacaagcctgcccctgaggccgtgtcacccttcagtgccgacacctatggtggcgcggagcggtccacgggggagtggaaccccaccgcggagtccatccgtcccgtgcgcggcaagcaccgcgtggccaagcagcgtggtctcgcccggagctccaccgtcctcggggtcggtgtcatagcggccgtcggtgcgggcggcatggccaccgcgcaggacaaggcgccggtctccatctctcttcccgattccatcgcggacaacctccccgacgccaagtcccttcccggcgtcgggtccttgatgtcggacgaggcggaggccgccccggtcgccgcagccgcgccgctcaccaccgccggcctcaccagcgcc

SEQ ID NO: 4217 - DNA, 1268 bp, Unknown
  Kingdom: Bacteria, Phylum: Actinobacteria, Class: Actinobacteria, Order: Streptomycetales, Family: Streptomycetaceae, Genus: Streptomyces
tccgacaccacactctccgccgaggccgcctccgtaccttccgccgagattgcccccgcgcggatgctcgcgcccgccgaccgctggcggctcgtgctcggccggcgcgccgaccaactgccgtccggggccgcccgcctggcgacagctctggacgagctctacggcgcgggacacggcgagggatcccgtggcggactgcccggccccggcggcaccggaccgcgcggcggccgggaaccgtcgttccccggagtccgcgagtggtcggaggaactggccgcgctgttcggccccggcgtccgtgaggaggtcctcgccgccgcagccgtgaccggacggcaggacgtcctcgccgagctcgatccggcggccaccaccccttccgtggaactgctccggacgatcctgcggtacgcgggcggcctccccgaagcacgcctcgcggcgctccggcccctggtccgccacctggtcgacgaactgacccgacagctcgccacccggttgcgccccgctctcaccggcacgatgctggcccggcccacccgccgccccggcggcaggctggatctgccgcgcacgctgcgcgccaacctggccaccgcccgccggacggccgacggaacgatccaggtgatccctgagaagcccgtgttccgcagtcgtgcccgccgttcggccgactggcggctgatcctggtcaccgacgtctccggatccatggagtcgtccacgatctggtccgcgctgaccgcctccgtgctcgccggggtgccgaccctgagcacccatttcctggccttctccacggaagtcgtcgacctcacgggccacgtgcacgatcccctctcgctcctgctggaggtgagcgtgggcgggggtacgcacatcgccgccgggctgcggcacgctcgcagcctgatcgcggtgcccagccggaccctcgtcgtcgtcatcagcgacttcgaggagggcgcgccgctcgccggactgctggccgaggtgcgggccctggtgaccaccggctgccacgtcctcgggtgcgcgagcctcgacgacgccggccggccccgctactcgacgggcgtcgccggacagctcgtggccgccggcatgcccgtggcggccctcagcccactcgaactggcccgctggataggggagaagaccgcatgaacgccgaccggttgccacccgtcgcgccggaagtcacggccacactcgtggagaacctctcaccccggctgcgcaagcggctggacgcg

SEQ ID NO: 4218 - DNA, 1953 bp, Unknown
  Kingdom: Bacteria, Phylum: Actinobacteria, Class: Actinobacteria, Order: Streptomycetales, Family: Streptomycetaceae, Genus: Streptomyces
atgcggcacgggctcgatggtgaccacctcggagcagcgggcggcgagccgccgcgaccaggggccgtaccagcccccgatgtcgagggcgacggcgtccggcgggcagaagtcggcgagccgcctgagctcgggctcgaagcgcgggtacagggcgacggcggccgagccgacgaggcccccgggcagccgggacgccaccgccgcggcgaacgtggtcacgtggccgaggccttgagccgggtgagcaggcgctcgtggtcgtccgccccgaccttccggcccgacgagggcagcagctgcgggatgccgtccacgatcgggtaactcaggcgcagccgggggttgtagagcgcctcctcctcggccagcagggacagcgggcccttgtcgagcgggcaggccagcagggcgagcagcgggtcgtcggggttcatcgggtggctcctcggtgtcaggggtgtcaggggtgtcggggtctcggatacggcgggccgtgtccggggtcaggacggggcggtgggctgcgggtcgtggcgtggcatggccagcaggacggagagggcgagcgccgtgccgcccacccgcagggccagcagcagcggatcgtcgggaagcgtctcgccgaaggcgagcgtcccgaggaccgcggtgaacaggctggtcaccgtggtgcacaccggcacgatgagggaggcccggcagcgctgcaacgccgtctgcgacatcaccagaccggcccccgcggtgaacagcagcagatacggatacggggacgccagcagcgacagcgcggcctcgcccagatcagtgctggtcaggcggctggacgtgcccttgatcgccagcgagctgaccccgtagagcaggcccaccgccactccgtacccgatgccgctggtcgggacccggtgccgtttggccgcccggcgctcgacctgtacgtacagccagacgcccgcccccagcgcgggcacgcagaccaggagcaccagcgtccccggcgcgccgccgctcaccacgtcctcgccctcgcgcaccgaggcgacgaccatcagcagggcgaccaacaccccgcccagcgcataacgttcgcgacccgtcgactcctcgccgagcacggccgacgacaacagcaggagcagcaccagaccggagacgaagatgccctgcgccgccgcgatcggcagcgcccggtagacgaccagctgggccccgaacccggccgccagcgccagcgcgccgacgatccacagcggactggtcagcagcacccggatcacccgcagcggccggccggcggagagcgcgggcagcgagcccagggcccgcttctccaccacgaagcccacgctgtacagcgcgttggcgaccagtgccgcgccgacaccccaccacatcgtcgctacctccgccgcgcgtgggccagcaggatggaggccgcccctggcaccgcgcacgccgcccggtccaccagccgcagcggacgcggtaccccgtggaagggggcgcccttgatcgtcacgtcggtgaagccggacgccgtcaggaacgagcgcagcgcgcgggccgtgtacagccgcagatgcccgaccacctccgagccggggcggccgtggatcccgcgcagactcacctccgagaacaccggctgcactccggcgagcagcagcgcccggttgtaccaggccgccaggttcggggtggacagcatcagatgaccgccgggccgcaggacccgccgcagctcgtccaacgcctggtccgggtcgaccagatgctccaggatctcgctgaagagcaccgcgtccgcacacccgtcggccagcggcagcccgccgtgctccagctcgccgcgtaccacgagacccatccggggtcgcgccctgcgcagcgcgtcctgcgaccagtcgacgccgatcagccggtgacccgcgaggaccggggccgctg

SEQ ID NO: 4219 - DNA, 1646 bp, Unknown
  Kingdom: Bacteria, Phylum: Actinobacteria, Class: Actinobacteria, Order: Streptomycetales, Family: Streptomycetaceae, Genus: Streptomyces
accccacccattcacgcctgcccccaccgaccgagcggcagttgcggcttgcacctcacgtcaacgtcaggttctacagtggcgagcgccggatgaacccgtcattccggcccgtcaaattaaggcagaccattatgcgcgcagcccggttccacgaatacggcggagcggagaacctggtgatcgagcaggcccccgacccgcaccccggagtcggtgagatccgcgtccgcgtcgcggcggccagtgtcaatcccatcgactggaagctgcgcgacggcgccctgcagcagctgattcccctggagctacccgccgttcccgggcgcgacgccgccggggtggtcgacgaactcggtgacggagtgcagggggtgagcatcggcgaccgcgtcttcgggctgggcgatgtcaccggcgcaaccgcggaactggtcgtcctctcggcctgggcccacgcccccgacacgtggaacgacgagcaggccgcgggcgccggtctcgcgtccgtgaccgcgatgcgcggtctgaacgcgctcggctccctcgcggggcgcacccttctcgtcgagggcgccgccggtggcgtgggcagcgcggcggtcgagatcgcggtagcgcaaggtgccacggtgatcgggacagccagtgaacgcaaccacgagttcctcaccgcactcggcgccgttcccaccacctacggtcccggcctcgcgcagcgcctgtccgctctcgccccgcgcggagtcgacgtcgcactcgacaccgcggcctccggatcgctggacgacctcgtcggaatcacaggtgacccgacgcgcgtcgcgacggtcgccgaccatgcgggcgggcagcgcctgggcacgcatgtggtcaacgcggagaacgactcctccctcctgtccgcggccgcggaactgggccggcaaggccgctacacaccccgtatcgaacgggcctaccccctggagcggatcgccgacgcccacgcgcacgccgagcgcggacgcacccgagggaagatcgtgatctgcgtctgaacaggccgatctgtagcggaacgggcgaggtaggcaacgcgcaacgtgcgggcctgcgtggcgagcgttccctcgatcggtaccggcggccggcgatccggagcaggccgatctccatggcgcctcgtccagcagccgccctcgcccggggactcccccgccggtgttcacctaccgtcggcggccctcgtcaccgtgccgatggcgcaggaggcgtcgtccgagagcagccaggtgaccgctccggcgatctcctcgggcctgccggagcggcccatgggggtgacgtggacctccagggcctgccgcatcccctccgggtcagcactggccagtggtccgaccggcccgctcaccccggcgttgttcaccggtccggtgaccgggcccgactgcgcggcggcggtgtcgaacagccggtccacgttcgccgcgtcggcggtgtcgaccgcgaccgtgacggctgcccggcccagcgcgcgcaccccttcggccacgctcaccgccgcacgcgtggcatccccaacccgatccacgagatgatctcccgctggatctcgttgttgccgccgccgaaggtgaagatcacggccgaccggtagccgc

SEQ ID NO: 4220 - DNA, 760 bp, Unknown
  Kingdom: Bacteria, Phylum: Actinobacteria, Class: Actinobacteria, Order: Streptomycetales, Family: Streptomycetaceae, Genus: Streptomyces
ggctgctggcgggactccccgcactcctgggcgcggacgacgacccggacgccttcgtcccccgccaccgcctgctcgccctgacccaccaccgccgcccgggcctgcgactcctccgcacgggcctggtcatggaatcgctgatcccctcgatcctggagcagaaggtcaccacggacgaggcgtaccgcgcctggcgccacctggtccgccgcttcgggacccccgccccgggacccaccgcggacctgggcctgcacgtcatgccggacccgcggggctgggcgatgatcccgtcctgggaatggcacagggcgaacgtcgacgccaagcgatcgtcgaccgtcctgcgcgcggtacgtgtggcccgccggctggaggaggcggcgacgatgaacctccccgaggcccgggcccgcctggaactgatccccggcattggcccctggacctcggccgagaccctccagcgctccaacggcgcgccggacgcggtcacggtcggcgatctgcacctcccgggcatcgtgggccacgccctggcggaccaccgcgacgcggacgacgaggagatgctggcgctgctcaccccgtacgagggccaacgccaccgagcgacccgcctgatcctgctctcgggccacaccccgaaacgccggtccccgaggatgaccccgggcgacatcacccacctgtagccgttccgaggaccggcgttcccggccctccggcgttgcttccagcccctccggcgtttgag

SEQ ID NO: 4221 - DNA, 2124 bp, Unknown
  Kingdom: Bacteria, Phylum: Actinobacteria, Class: Actinobacteria, Order: Streptomycetales, Family: Streptomycetaceae, Genus: Streptomyces
cgccggagacgtgctcgtggtgcgcacaccgggcggcggaggatacggacccgcgcagacctgaccctcccacgggaccggtcgcataaacgccgtttcgaccgttgtcggtgcgaggacctaatctgtcccacgtgacttcgcctgcctacccggacaccgcctcgccgcagctcagcgcggggccgcggcctgccccgggccccgccgccgacgaggggctctcgcggcggctgcgcgcgctcgcgtgcacggcgccgctgcacgacctcgacgtccgcaaggcgaatctggccggcgagtacacggtgtacgccatggcggaggtggccctcgccgcgatcgaccacgtcacgctcaacatggacttcgacaccggagccgaccacgaccagatagtggccagactgctgccccgggtcggtgcccaggcccccgaacgccccgtcgccgagcacgaacgggtcgcccgctgggtcctggagaacctgatcaacgtcggcagcgtcgaccgcgggttccgcgcggtctacggcaccttcggccccgacggcgtctatgtccgccgggactacgacttcaagctcatcgaagaggtcccgggctacggcggcacggtctacctccgcgccaccgacgaagcggtcaacgtcctcgtcggcgcgctggacaccgatgtcaccagcgctcagatcgccgccgaggtcaagctggaggtcctcatcagccggggccgcctcgccgacgcccagctcgccgccgaacaggcccgctaccgcaccgtgcagtacgccgagaccctgcgccggaccctggaggccacccggcgcaacgtccgcgccgtcgactggctccacaccgtcccggacatgatcgccgaggccctggaccacgtggccgaccgctaccgccacgagaacgccatcctcaccaacatccgcaaagcacgcgacgaggccgaggaccccgagcacaagcgccgggccgccgagctcgtcgacatcgtcaaggactgcatccgccgccacacccagctccagtcccggctcctggaggcgggccccctctttcgcgccgagcaggaccggcaggcgttcgctccgcccgccgcccacgcgggcctcgacctgtacgggcagctcctcgctccgctcctccccctccccgtcgaacagtccacccgggccaccgacgccttcttcgcccacggcaccggactgcgcacccccacctccgtacgggtcggggacctggtcgacctgctgctcaccccgccgctggagcgcgagcacctgggcgcggagatgccggagcccgacctcatcgccacccccgacgacagccggttcagcgaggagcagctcgcccgcgccatgaccctgctcgacctggagcacgacgccccgcgccggctctccggactgcttgccgaggcccgtggcaccggcgacaccgacctgccgtacctggtcgccctgctcgccgtccacgccgccagcccgccggtcggcaccgcctaccgccagggcgaacgacgcctgctgttcgccgtggacgacggggcgcagctggacgacccggagttcggcggcgccgacctgatcgtgggcaccgccctgctggacgccgtcggcatggccgccgaccgcaaggaggcctcgtgaccggccccgccgcttccgtcatggaccgccccgcgcacgccgccgcgacccggcccgtcctccttccgcacccgcacgtcttccgtaccgaggagtcccagccgtgagcgaccacgacgccgagcaccccgacgcgtggaccgagccctccgcgtacgccgtgccctccaccccgtacgcgggcgactccgcgcacccgggcgccgccgagcacgccggccagcagcccgtcaccccggccgacgccgccgacgcggcccgtctggtctccttcgggctccagcccaagctgctgcccgcccgcgacgccgagtacgccgacctgctgcggcgctaccgcgaggagagcgccttcgcccggctcgccgacgccgtcgccaccggcctcggcctcatcgtcctggaggtctccccgcgcgccgggatggccgtgaccgcgggcgaggactccgtcttcgcc

SEQ ID NO: 4222 - DNA, 1936 bp, Unknown
  Kingdom: Bacteria, Phylum: Actinobacteria, Class: Actinobacteria, Order: Streptomycetales, Family: Streptomycetaceae, Genus: Streptomyces
gcgaacgcggcggacctcgccgtgcccggtcccggccggggcgaccccggccgacctcgcccggctggcgggcctgccggaggagacgctgccacgcgagcaggtgcggaccctgttgtttccgggcgggcggccacggctgctggagacgctgagtacgccgctgggccgttcgggcttcgtgtgcgtcccgctgttcgcagacgaactcgcccccggagacgacctgctcggacacaccacgcggggggtggaggtcgcctcgtccctcggtgcgcgggccgtgtccctcgcgggcatgatcccctcgctcaccggctacggcttcgacgtgctgcgggccgtcggcacgaccggagcagtcacccccgagcccaccagccctgccgtccccgctcatcaggctgatcacggtggccctgccacccgcaccacccccgtcgtcaccaccggtcacgcggcgaccgtcgtgtccgtcgtccggaccgtgcacgcggctctcgacgcgacggggcagcaactgggctctctcaccgtcgcgttcgtggggctcggctcgatcggctcctcctcgctggagttgctgctcacccgggcccagcagccgcccgcccggctgctgctctgtgacgtaccgggcagcgggccacggctgaaagaactggccgaaagcctcctggaacgcggcctggtcgagagcgtggaggtggtcgagtccgaccaggggctgcccgacaccgtgtacggcacccgcctgatcgtcgcggcggtcagcgggggcggcgcgctcctggacatcgaccgcctcgcaccgggtacgacggtggtcgacgactcgttcccgcactgcttcgacacgtcccgtgccatcggccggatggaacgggcaaaggacgtcctggtcgtgggcggcgggctgctgaacgccggccccgcggaacggcgggtggcggagggactcccggccgccgcggtggccggatacctcgcgcagccgatggtgccggacaccatcgcgtcctgtcggctggagtccttgctccaggcctcgggggccgatgtgccgctcgtccacggtccggtcgacgcggcaaccggactgtcctactgggaagcggcggaggcgaccggcatccgcgccgcgccgctgcacctgctcacccacaccgtcgacccggacatgttcacgcgacccccctggagttcatgacccttccggtacggatgccgtgtgcgctggagcgggcccggcgccgggacgtcgcgggctgtcgaccgcgttgtcagtggtcgggattaagttcgttcatgtcccgccgcgatggcgcggacgtccccctttcgcatgcatgggagttggcacgttgtcggtctgggagaaatcgagtacggcgcgggtgatgccgcccgcgcgcccgcgcaagctggccaaggtgccgttcgtcgaactggccgacgggcggttgcagggagtcgtctccagcggatcggacatcggccgggtgtacgtgtcgtccgtggcggcccggacgtacgcgttcgcctgcagcaccaacaacaaccggccctgtggcggcgcgcgcggcatgttctgcaagcacatccaagctctcgtcggcgaggcggtgctgcagtacggcgcggagcgcgtcgcccgctatctcgcggtggagaccccggacggagaggccgacgcgcggtccctcaccgccgtcatgaccgccgcgcggccggtgcagggcgactcctcggcggccgcccaggtgttcagccggttcctgcgacacctggcctatctcgaactggacgcggtcaccgcaccgttgcccgagatgcagtggttcccgccgacgcgggcggtggcctgatgcgtggcgacctgctgtccgatccggtcgaggggctcgacgaggcgctcgccgccgtggacgccttc

SEQ ID NO: 4223 - DNA, 517 bp, Unknown
  Kingdom: Bacteria, Phylum: Actinobacteria, Class: Actinobacteria, Order: Streptomycetales, Family: Streptomycetaceae, Genus: Streptomyces
tcgtgcagggggcgatctccacctgcgggtggttgcgcatccgctccaccttccaggcggaggagaacgtgcggatgaacgcgtgatcgccctcgacggcgatgttgacgggtgtgccgacgggggtcccgtcctgccggtgggtgctcagcaggacggcgtactgcttgacgaaaggagcgagctcccggctggcgtccatatatccattggggcacgggccgggggtgctgtcatttccgggccgctgtccgctccgtcgtcccgtccgtcgtcccgtccgtcgtcccgtctgccgtcccgtccgtcgcccgctccgccgtccgctcctcgaccagggcctcgaaaccggcgatcagccgtcgcagtccgaactcgaagtgatcgaactcggcgctgaaggcgtcctccgacaggctcgccatcatcgggtacgcgccgctgagcatggcccgctccaggtaggggcgctggtcgtcccagaactcctggtcgctcaaccccgtctcccgcaccg

SEQ ID NO: 4224 - DNA, 1824 bp, Unknown
  Kingdom: Bacteria, Phylum: Actinobacteria, Class: Actinobacteria, Order: Streptomycetales, Family: Streptomycetaceae, Genus: Streptomyces
ggcagctcggccgcgagggtgcgcagctcccgctggcgcgaccagatcgccagccaggtcaccaggccgaacgccgggaccatgacgatcccgtacaccgcgtagaagccgtacgggccgaaggacgacgagccgttccacagggcgtgcagacccatcgccagcagcagccccagcagcggcagggcgatccggcgggcccggtggcggcgggcgctgacggcggcgaagccgaagccgaggccggtgaggaccgtgaacaggggatgcgcgaacggcgacatcacgatccgcacgaagaacgttccggccgtcaccgaggcgaacccggagctgccgagctgctggtcctcgccgaaggcgttgcccagatagaggatgttctcggtgaacgcgaagcccgtcgcggtgaagccggcgacgacgatgccgtccaccaccccgctgaactcccgtctgcggaacaggaagatcagcagcacggccgccgccttcgcgctctcctcgaccacgggggcgatcaccgtcgctcccagggtgtcggcgctcgccgggtcggccgtcgcggtggctatccagcgcgtcgcgaacgagttggcgatgatcgcgacgagcgcggcggcgcacgcaccccaggcgaaggagaacagcagattccgccagggtcccggctcgacccggtccagccagcggaaggcggccatcaggagcggcaccggaagcaccgccaggccgagaccgacgaggaacccctccgggccggtctgctcccggacgagggccaggatcaccagcccgcacagcacgagcgccacgatcacggccccggcgcggaacaccttgctgcgccacaccatgccgacgcggcgcggccggtaacgtcctcggccgcgctccggcgcggcgcccaggacctcgtcgagccgctgctcatggaggaccgggacggcgggtcgcgcctgctgatgctgcacggaggggtcggacacctctcgaccctaacgaggagcaccgacacccggcgacggcgcatccggccaggacacggccgtggagccgtcgcgggcggtgggcgtcagacgcgggcgaacagcaggtcgtgcacgacgtgccccttgtccaggccctgtccctcgaagcgggtgagcggccggaacgcgggacgtggggcgtacccgccgtcggccgcggtgttctcgaagcgggggtgcgcggtgagcacctccagcatctgctcggcgtacggctcccagtcggtcgcgcagtggacgacggctccgggcctcagcaccggggccaccaggtccaggaactccggttggatcaggcgccgcttgtggtgccgggccttgggccaggggtcggggaagtagacccgcaggccgtcgagcgactcgggggccagcatctcgcgcagcaggatgaccgcgtcgccgttggccacccgtacgttggtcgagccggccttgtccgcgaggcccagcagattgccctggccgggggtgtggacgtcgaccgcgaggatgccggtgcccgggtcgtcggccgccatctgcgcggtggcctcccccatgccgaagccgatctccaggacgacgggcaggccgtcgaacagatcggtcaggtccaggacgcgctgtccgtcgatgtccagaccccacttcggccacagccgctccagggcgtcctgctggccggtcgtgacccggctgcggcgcggctggaagctgcggatccggcgctcgtggtgcgagccggcggggtcggcggctgggccgccggggaagcggggctccatgcgcagccgctgcgcgcgctcgaagg

SEQ ID NO: 4225 - DNA, 1834 bp, Unknown
  Kingdom: Bacteria, Phylum: Actinobacteria, Class: Actinobacteria, Order: Streptomycetales, Family: Streptomycetaceae, Genus: Streptomyces
ggtctgcctggagctggacacctcgttgcggatgctgggcggccgggtccggatcggggcgctgcgctcgccgctgcgatcccccgcacagctcgccgagctggcgcgctcggtggcccgcaggccgggcttccggctggtgggcctgatggcgtacgagggacatgtcgccggggtcggcgacgcgctggcggggcggccgctgcggtcccgggcgatccggctgatgcagtcggccgcccgcagggagctggcggtgcgccgggccgaggtggtgcgggcggtccgggcggtcgcaccggacctggagttcgtgaacggcggcggcacgggcagcgttcagcacacggcggccgagaccgcggtgacggagatcgcggccggttcggggctgtacgttccccggctgttcgacaactacacgtcgttcaccggccggccggcggccctgttcgcgcagccggtggtgcgccggcccggcgtgggcgtggtgacggtgctcgggggcgggtatccggcgtccggcgcggccggcgccgaccgctcgccggtgccgtatctgccggagggactgcgctacgacgcgcaggagggcgcgggcgaggtgcagacgccgctgctgggctcccccgccgacgacctgctgatcggcgacaaggtctggttccggcacgccaaggccggggaactgtgcgagcgcttcgacgcgctgcacctgatcgagggcgaccgggtcacggcgagcgttccgacgtaccggggcgaggggaagaccttcctctgaccccgggtacgtgcggggggatccagggtctcaggggccgatggacgcaccgacgccaccgctcgtcgcgctgtcgccgagcgggcggatgccccgggtgatcgtgtccatcagggacagcggcaggccggggacctcggcgtcgaagacgaaccggacgatcaccggtgtctcggtgcccaccgaggaggggaaggcgagggactgcacgaacccgccgggccccttgccggtggtgacctgccagcgcaccaggtagccggtgcggccggcgacggtcagctcctgggccttgagcacctggtgggaggtgatgccgccgtgggtgcgccggccgaggctgtcctcctcgtaggccttgtcggccgcggtgacgatgtcggcctcggccagggttctggcatcggtctcgccgccccgggcggtgcgggtcgtgacggtgccgtggtagcagaaggatgcgcctccggggcagtcgtaggactgctcggtgcggatggtgggggcgtcgtcggaggtgctctccggtttctcccagcccttgggcaccggcagggtgatcccgttgagctggtcgacgaggacggcggggtcctcgtccgggtgggactcggcggaggatgacgcggtggccgtgggggtggtgacgcgggccggggacgacgtggtcgtcgtcggagccgcaggcgtaccgccctcgtcgcggcccagcagcacggcgccggcgacggcggcgcccaggaccagcaccccggagagcgtgacggccaggaccttcgtccggctgccgccgccggatccgtcgttcggaccgcgctggtgcgggagcggaagcgacggcgggccgaacgccgcgggtgcgggcggctgttccggcgcggcgtgggcggcggcgagcgggcgggtgtgcatggtccaggccgtgccgtcccaccagcgttcgtagccaggtgcgcccgtgtccgggtaccagccgggcggcgtgtcggagccggaccctagagtgggggcatgagctacgcgacgccgcccggctggtacccggacacg

SEQ ID NO: 4226 - DNA, 2191 bp, Unknown
  Kingdom: Bacteria, Phylum: Actinobacteria, Class: Actinobacteria, Order: Streptomycetales, Family: Streptomycetaceae, Genus: Streptomyces
ggcaaggtcgccttcggccgggtcacctggaccctgcggcgcggcggggtggcgttgcgcgtcgaccggagggccgtctgcgtctgcggcgtcctggccgtcgtggtcgccgccctgggcatcgtgacgctgggctccgggtcgatcggcctgacgcccgtccaggtgctgtccgccctcctcgacccgaacgccgatccccgggcccgcctggtcgtggtgacctggcggctgccgaggctgctgttcgccgtggtgtgcggagcggcgctcgcgatcagcggcgctctgttccagtcgctcaccaagaatccgctcggctcccccgacgtcatcggcttcgcctccggttcgtacgcgggagcgagtgtcgtgatgctcctgctcggcaccgccgactacctcgcggtggcctcgggttcgctgatcggcggtgccctgacggcgctgctggtgtacctgctggcctaccgcggcgggctgcggccgttccggctgatcatcgtcggcatcgccgtcggcgcgttcctcggctcgctcacgtcgatgctcctcctctccgtcagtccgcagcaggcgatgctcgcggccacctggggagccggttcgctcagcgggctcggcttcgaccaactgcgggcgaccgccgccgtgttcggtgttctgctggtcggctccgccctcgtcgtacgtcccctggtccatctggagatgggggacgacgcggctgtcgcgctcggggtgcgcgcccagcgcgcccggctgaccgccaccgtcttcggcgtggcgctcacggcactggtgaccgccgcggcgggcccgatcgccttcatcgccctcgccgctccgcagatcgcccagcggctgacccggagttcgaccaccctgcgcatcgtgcccgccgcactcgccggcgcgaccgtcctggtcggcgcggacttcatcgcccagcgcatcgatctgccggtcggggtcgtcacggtgtgcgtcggcggcggatacctggcctggctgctcgcgcgccagtacgcgggccgtcgtcgatgaccgcccggcgcacgcctctcccggcgcggcccaccccccactctcccgaggagcgacccgtgagcaccacgaccccgccggcccggccccggcagcgggacacccggtgaagggccccgagccctgccttcccgaggtgggcctggaccgcgaacgcgcctccgtacaggagctgttccgtaccgcactcgtgcgggacggccgcggcctgcggctcggtgtgaccgccgccgcgttcatggtccatcagctgtgcgaggccacggtgccgatcctcatcggggtcgtcatcgaccgggcgctcgccccctccgacggcccggctctcctcgggtggctcaccgtgctcgccggggtgttcacgctgctgtccctctcgtaccggcgggcatcggcggcgatggtgaccgtctacggatacggcgaacaggcgttgcgtctgcgggcgatggccaggctgctggacccgcgctcgctgcggcggcggcccggggcgggcgaggcgctctcgctggtctcctccgacacctaccgcgtcgccggggtctcctggagtgtcgtccagcaggcgtccacggtcaccgccatcctgacggcgtcggccgtcctgctgctgatctccctcccgctcggcgccggggtgatcgccggcacggttctggtgctgctggtcatgcggcggatctcgatgccgctggaggcacgggggctggccgagcagagttcggcggcgcgggccggtgacgtggccacggacatgatcaccggcctgcgcgtggtgaccggcatgaacgcccacgccgaggcggcccgccggtaccgcgtcgcgagccaggcctcgcgccggggcgccgtcgccgccgcacggtcggtgctgacgtactcctgcgtgagcctgctgctgtccggactcttcctggccgcgctcgccaccgcctccgggtatctcgctctcgacggcggcatcacgatcggtcagctcgtcactgtcctgggtctcgcccagtacctccagggttccctcgcccacgtgggcaccttcgcctccaactggatccacaagcgcgcctccgcccgccggctcagtgacctcatcaacgaacctcccctgatcggcgccgtaccgggctcccgggacggccgg

SEQ ID NO: 4227 - DNA, 838 bp, Unknown
  Kingdom: Bacteria, Phylum: Actinobacteria, Class: Actinobacteria, Order: Streptomycetales, Family: Streptomycetaceae, Genus: Streptomyces
gcgcagggcggtccgcgcgccgaaccggtggctgatccggccggcgagcggcatcgcgatcgacgcgccgatcgccgggaaggccagcgccaggccgagctggcccgcgctcactccggcgtgatcctggatccacggcacccgggtcgcgaaactgccggtcaccgccccgtggacggtgaagaccgcggcgatggcgatccgcgcccgcttcacctgctccgtgctgtagaccgtgacggtcgggtcgtctctcatgccgtcgtgtcctcccctgggaattctcggacgccggcggtcccggcgctcccgtgcgacgatgcggggcgtaaactatcaggaaccctgcctgataaatagccgttacttcgcggccccggaaaacggtggggcggcgatctggaaggatcccgctatgcccgcatcaccgagcacggctcgggccatcaacgaccggctagccctgcggctgctccagcaggacggcccgctgacggccacccagctcaagacgctgaccggactctcccgcccgaccgtcgccgacctcgtcgaacggcttcagggggccgggctgatccgggtcgtgggcgagtccggggccgtccgccgcggacccaacgccaagctgtacgggatcgtcgccgaccgggcccatctcgcggcgctcgacgtgcgtctcggaagcgtcagcgtggtcgtcgccgacctgttgggggccacgctcgccgagggctccctgcccatcggcagcgacaccggcaccgagccagccgtcgagcgggccgccgcccttctggagcgcaccgcccgcgcggccggatccgtccccctgcac

SEQ ID NO: 4228 - DNA, 1112 bp, Unknown
  Kingdom: Bacteria, Phylum: Actinobacteria, Class: Actinobacteria, Order: Streptomycetales, Family: Streptomycetaceae, Genus: Streptomyces
ggagatgggtataagaggcagggtccaggccccgtacgccgcggacgcgcaggccaggacggcgaggacggcggccgtacgcccggtcgtgcgcagccgcagcagggcgacggcgggcgggagcagcagcgggaacgcgggcatcatcaggcgcggccgggagccgaagtacccggcgccgatcagggagatgacgacgatcgtgagggcgtagacaaggaccgggagcggctgccgctgccgtacgcagaggaccgccagccaccccagcagcccgagcgcagcgcacaggccgagggcggcgggccacgggagtccggcgatgaaggcggcgagcgcgcgaccgccgtcgatgttgttgccccactgcgcctggacgtcgaagtaggcgaaggggctgccctcgcggacggccacgaacaccacgtacgccagccagcccagcggcgcgagcgccacgcccgcgatcatccggacgtggcggcgcagcaccgggccggcgcggcgctcgtcgcggtacccccgtacgagggcgacggccgcggtgatcgccaacgcggcgatgagcgcggccgccgtgggccgggtgagccccgccaggacgcagagcgtgcccgccaggatccagcggcccttgaggacggcgtacagcgcccaggcggcgagcgcggtgaacagggtctcggtgtacgccatcgactggacgaacgccgtcgggtacaccccccacagcgcggccagcaccacgcccgtacgccgtccccggagccgggcgccgacggcgaagatgccccaggcggcgagcaggccggccgtccaggcgaccaggagtccggcaccgccgggggtgagcggtgtcacctcggagatggcgcgttccagggccgggagcagggggaagaacgccaggtcggagtggacggagccgtcggggagggtgacggtgtagcggtagccgttctcggcgatgcgctggtaccagacggagtcccagcgtccgctgagcggccccagggggtccttcccggcggcggacgcggctgcccagaaggccaggagccccagggtccgggcggcggcgtagaccgcgagcgcgggcgcggccgcccgga

SEQ ID NO: 4229 - DNA, 561 bp, Unknown
  Kingdom: Bacteria, Phylum: Actinobacteria, Class: Actinobacteria, Order: Streptomycetales, Family: Streptomycetaceae, Genus: Streptomyces
accgccacccgcgcctgggcccacaccgagcaacacgccaaccggcagctcggcctggtcaactccgagcggcgggtcggcgtggtgacccacaccgacgccggcgcggtcctgtcccggacctggctgggcggcctgtcggagccgtggatgttcgagggtccctccggctacgcgctgacccacaccgtcttccacctcacggactggggccggatgcccgaccgggtccccgggaggatcgacggctatctgcggacctggctgcccgcgtgggccgacggctgcctggagagcggccagtgggacctcaccggcgaactcctcgcggtggcggcgtcgctgcccggaccgccgcccgcggaggcgctggacgcggtctggccggtgctggcaggagtccagcacgcgacgggctgtgtcccggagaccggcgtaccggttaaggacccttcaccggacccgtaccccttcatcgactgctaccactccacgctcgtgacggccttcgccgcggccctgtccctgaggacgctgcgcggggccggcgaggccgtgccc

SEQ ID NO: 4230 - DNA, 1506 bp, Unknown
  Kingdom: Bacteria, Phylum: Actinobacteria, Class: Actinobacteria, Order: Streptomycetales, Family: Streptomycetaceae, Genus: Streptomyces
gcccggtggtggtgtgggtggggtggtggtgcctccggtggtggagtggttgcgggggttgggttcgggtgtgggtggttttcatcagtcggtgttggtgtcggtgccggcgggtgtgggtgtggatgtgttgaccgcggctgttcaggggctggtggatcatcacgatgctttgcggttgcggttgttggtgggtgctgatgggggttggggtcttgaggtggggccggtgggttcggtttccgctggtgggtgtgtgcgtcgggtggatgtgtcgggtggggatgggggtgtgttgtcggagttggtccgggtggaggcggatgcggctcggggccggttggctcctgagttgggtgtgatggtgcaggtggtgtggttcgacgcgggtgcggggcgtgctgggcggttgttgtgggtggtgcatcacctggctgtggatggtgtgtcgtggcgggtgttgttgccggatctggaggtggcgtggggtcaggtttcggctggtggtccggtggtgttggagccggtggggacgtcgtatcgggcgtgggcggggttgttgcccggtctggctgaggatcgtgtgggcgagttgtcgttgtgggagggggtgttggcggagcctgacggtttgttgggttcgcgggtgctggatccggtggtggatgttgcggggtctgcgggttcggtgacggttgaggtgccggcgggtgtgtcgtcggcgttgttgtcgtgggttccgggtgtgtggggtgcgggtgtcgaggaggtgttgctggctgctctgggtgtggcggtgtgccggtggcgtgaggggcgtggcgggggtggtggtcatgttctggtggatcttgaggggcatggtcgtgagcaggtggtggatggtctggatctgtcgcggacggtggggtggttcacgagtcggtatccggtgcggctggatgttgagggggtgggtgtcggtggtgcggtgaagcgggtgaaggaggtgttgcggggtctcccggaccgggggatgggttttgggttgttgcgttatgtgcgtgaggactcgtcgcgggtgttggcgggtctggcggagccgcaggtggggttcaactatctgggtcggttccgtgctggtggtggtgggggtgactggttgccggtgggggaggccggtggtgtgggtggtggtgttgatccggcgatgcggatgccgcatgcgttggaggtgaacgcgctggcgttggacggtgtgggtggtccggtgttgtcggcggtgtgggcgtggccgggtggggtgttcggtgagggtgaggtcgaggctctggcccgggagtgggtgggtgttcttgaggcgttggtgggggtcgcgggtgagccgggtgcgggtggtctgacgccgtcggatgtgctcgcggaggtgtcgcaggcggacatcgaggtgttggaggaggcgtatccggggctccgtgacgtcctcccgctgtccccgttgcaggaaggactccacttccacgccct

SEQ ID NO: 4231 - DNA, 1887 bp, Unknown
  Kingdom: Bacteria, Phylum: Actinobacteria, Class: Actinobacteria, Order: Streptomycetales, Family: Streptomycetaceae, Genus: Streptomyces
acgtccatcagcaccacgtcgggccgcagctcccgcaccacggagacggcctccgcgccggtggccgcctccccgacgacctcgatgccctcctcggcgtccaggatcgcgcgcaacgccgtacgcaccatccgctcgtcgtccgccaccaccacccgcaccgcggccccgctcatcgccgtccctccgtccgcccggccgtacccggcaccgccagcggcagccgggcggtcagccgccagacgccgtcgtccggccccgcctcggtccggccgcccagcaggacggcccgctccgcgatgccgcgcagtccgcgaccgcccccgggacgcagcccggcgggccgctcggccagcggattctccatcacgatctccagctccctctcccgtaccgcgatcagcagccgcaccggggacgcgcccccgccgtgccgcgacgcgttgctcagtccctcctggacgatccggtacgcctcccgcgagaccaccgggtccacgctgtccggatcgccctgccgctcgtacgccaccggcatcccgcagcgcgccagcagtccgccgagcgcgtcgagccccggcgcgtacgccgtgtcctcctcgtccggctccccgtcctgccgcagcagccccaggaccgagtccagctccccgaccgtccgccgtgtcgtctcctcgatggcggtcagcgcctcgcggacgaactccgggtcgtggtccagaacccggcgcgccgcccccgcttgcagggtcaccgcgctcaacgcgtgtcccaccgagtcgtgcagctcccgggcgagccggttgcgcaccgccagatccgccgcacggcgttcggcggcggccagccggtcctcgggcgtcggccccagcaacaccggggcccgccgggccagcatttccccggccaccgccgcgaccagcgccagcgccagcagcatcgcgagcccggcgaacggcgcgagggccagggcccacggttcccgcagcgcctcgggcccgtcgagcagccaggtggcgcgcagccccgcgaagaacggcagggcggccaccgccaccgcgaacggcggcagcgtcagggtgctcccgctgatgattccgccgagcgccagatgcagcgtgtaccagccggctgtacgcacccgggactgccgggtccgggcgagtccgtcggccagcagagcgggcggaaccccgcacagggcgcgggcggcggccacggacagcggccggacgagcgggaagaagccggtgaccgccgccaacgggagggcgatggcgaacgcggcgagctgggcgggcagggaggagaacagcgccccgccacccgccatgccgaccaggaccgtgccgaccaggaagtacggcatcagcagcgcgccgccgatgatcagatgcagccagcgcagccgcgcccgccgtccgaacagcgcggcgagcggcttcatgacacccggtcggcggcggccgcggcggtgcccgcggtcgtgggcaccgcggaggccgccgagcgctccgcgaagaagtaggcgcccagcgtcacgacgagcgccccggccagcatctggacagcgtaggtcaacaccgtcgccgtcgtcggccggtccgccgcctcgcccgcgccgatcagccccgcgatgctcaaccagccaccccagcaggccatttccgccgaaccggcccaggccaggacgagcggcagacgcagggagaggcggccggagcgccggaaggccagcagcagcacgccgacggcggtgaccacgacgaagagcaggttgacggcttccaggacgtagaagtcgctcgtgcggtccgccgcccggcccgcgccgagcccggcggtcgaaccggtgacccacagcaggtgcgtgacgccggggaagag

SEQ ID NO: 4232 - DNA, 1006 bp, Unknown
  Kingdom: Bacteria, Phylum: Actinobacteria, Class: Actinobacteria, Order: Streptomycetales, Family: Streptomycetaceae, Genus: Streptomyces
cggcgtccgccgccccgctcccggccgctcccgccgaggcgagccgacggcgtggagcggacatccgtgcggccgtggccagttgagcccggagcccggggtccgccagaccgcgcagccccacggtggccaccacatgggccggggtcatcacggaggcgtacgcggtccggaaggcgccggcggcgtggtggccggcccgggtgatccgggagcggagcgaggcggcgaccacgagcccgctgaagccgccgatcaggatcgcgggcagcaacttgacgatgaacggcacggggtagcccgtggaaccgtcgtgcacggcgtactggacgaacgtgagcaccacacccagcggcaggccgcccaggcacaccgagctgtggaccagcgcccaccgccgcaccggccgggtccgctggggcggcacgagcagtccgcgcgccgcgagcccgtcgccgatctcctggaccgccgggtgccgcatcaccgcttcccgcaccaggtgcagggcgccgctgggcgccgcggacagctcctggagtaccgcgtgctccaccgggtcgttggcctccgcccaccgcacggagacgatgccggggccgccgatgaggatccggccgttcgactggagggaggtcagcgcggtgtccgccaccctggccgggccgccgttgaggaacgccgcctcgtacaggtggtggagcgtgaggccggcgtgggccggcgggcggggggaccgggcggcgaccgccttgacgatgagcagcaccgatgagacgacgaccgcgagggtcgccagcagagcgagcacgttcacggcgttcacttcctcacgagggcggcacgggccgcccggaccagacgggtggtacgacgcggcggccgggtgcccgagcggtcctgccaccagtacgtcagccggcgccgcgccaccggatcggcgggaccgcccgcgatgagcacgtgctccgcgaagtccagggcgtcgcgccggtacccgccggac

SEQ ID NO: 4233 - DNA, 773 bp, Unknown
  Kingdom: Bacteria, Phylum: Actinobacteria, Class: Actinobacteria, Order: Streptomycetales, Family: Streptomycetaceae, Genus: Streptomyces
ggccagcgggccggcgcccagctcggccagcagctggcgttcgatctgccgtgcggagtagccgagccgggaggcgagcccgggcacgccctcgcggtcgacgactccgtcccggatcagccgcatggcgcgggcgaccgagtcggcgcgggcgttccactcgggggatccggggctggtgtcgggacggcagcgcttgcaggcccggaatcccgcctgctggcaggcggcggcactcgggtagaaggtcatgttgcggacctttggcggcacgacggggcagctggggcggcagtagatccgggtggtgaggaccgcggtgaagaaccagccgtcgaagcgggcgtccctggactggacggctcgcacgcagcgctcggtgtcggtgtgcatggttccaggatggtgcaccggtcaggggcttggctggcggaaatccgacagggccctcgcgcggaaatccgacaggcgtccgaactctcccggtggccggtggcgcggtctcagcgcgtcgcgaggacttcctcgaactccacgtacgcgtgggcgtcgaagagcacgaagcgcacctcttcgaccggctccacggtctccgccaggaccgtgcgtacggcgatccgggccccgtcgtccatcggccagccgtagatgccggtggagatcgccgggaacgcgatggacctggcacccaactcggcggccaggcgcagggattcgcggtagcaggaggcgagcagggcggaccggtcctgggcgccggagaagacggggcc

SEQ ID NO: 4234 - DNA, 915 bp, Unknown
  Kingdom: Bacteria, Phylum: Actinobacteria, Class: Actinobacteria, Order: Streptomycetales, Family: Streptomycetaceae, Genus: Streptomyces
gtggtgcgcgggcgcgtccacgtccggcgcacggcgcgctcgggggcgctcggtggccgtgcggtcacgcgctgccctcccttggtcccgtccggcgtcatgcgtcggcaaagggcggccaaaggaggccaagaacgcaccaacattggccctgagctggtgcgtccgtacgggtggaggtgtccactggaagggacgggccacctgctcgaaaagcctcgggcgggccgcccgtccccggagcgcgtgacccgcggccaagaggagcaggcatgagcgagatcgcagccaccactgtccatgaggcgtatgccttcgcctgtatgaagtgcgggtacggctgggagcagtcctacgagatagagcaccacgtcgacgtccacggtcacgccttcgtcgtctacacggcggacggcgagcgcgtgccgtccccgctctccacgcccacctgcaccaactgcggcggacacgtggtgcgcatcatgcgggcggggcgggtcgccggcgtccaggagctgctgcggaagcagcaggcgccgcgagccgcagaggccgcagcgaaggaccggacggtgtcgaccgccgccgccccggcccgccactggcggctgtccgacctgctccaccccttccaccgcaggtgacctgtgccgaccactgcgggtgacgtgatccttccggggccctcgtacgatcgtcggcatgagccgtaccgaagccccgccgctgcccgagcccctgcgggttccggtcgccgactcccacacccacctggacatgcaggacgccaccgtcgaggaggccctcgcccgggccgccgcggtgaacgtgacgacggtggtccaggtgggctgcgacgtggccggctcccgctgggccgccgacaccgcggccgcccaccccgccgtccacgcc

SEQ ID NO: 4235 - DNA, 2398 bp, Unknown
  Kingdom: Bacteria, Phylum: Actinobacteria, Class: Actinobacteria, Order: Streptomycetales, Family: Streptomycetaceae, Genus: Streptomyces
gggcggtgggagggctcgcgctgctcgcggtgcccgcgctccgggacgcgggctggcccaccttcctggccgtggtgtccgccttcgcgctcggctcgctcgcgctgcacggcagccgcagctggctgggcgtgctgatcggctcgctggggctgttcgactcggtcgtccccggcatcatctggggcgtacggggggtgcgcgcacgggccgacggttcccgggcgcgctggggcgccgccctgcgcaccacggccgtggccctcgtgctgctggtggtgttcggaaccctcttcgccagcgcggacgccgcgttcgccgaactgctgggcagcctcatgcccgacgcctcggtcggcgagggaccgtggcgcatcttcctcttcgccctcgggctcgcgggcgcgctcgccgccgcgcacgccgcggccgcccccgtgcgctgggacgggctcaccgtacggcccggtaagccccgcgggcgggccgaatgggcccttccgctgatcgtcctcaacctgctcttcgccgcgttcatcgccctccagctcgtcgtgctcttcggcgggtacgacaaggtgcgggacgtgaccgggctcagccacgccgagtacgcccgccagggcttctggcagctgctgtgggccacgctgctcacccttctcgtgatcgccctggccctgcgctgggcgccgcggggaggcaccggggaccgcaccctcgtgcggtcggtcctgggccccctctgcgtcctcactctcgtggtggtcgcctccgcgctgcgccgcatggacctgtacgtcgacgagtacggcctgaccagactccgcatatccgtggccgcgatggagctctggctcggggtcgtgctgatcctgattctggcggccggggtcttcggggcccggttcctgccccgggccatcgcggtgagcgcggcggccggtgtcctggccttcgggctgctctcaccggacgggctgatcgcggagcagaacgtccagcgcttcgaggacggcgagtcgaccgccatcgacatcgactacgtcaaggacctgtccgccgacgccgtaccggccctggaccgactgcccgaaccggaacgctcctgtgcgttgcggatcatccagaacgatgtcctccacgccggcactccctggtacgcgaccagctggggagaggcgcgggcgaaggagatcctggagaagcggccggtgaagggtgacgggagcgactgctacagcgtgggcagggaaaggacgcgggacggctacgagccggacgacgacggctacgacccgtactgaggcgtcggactccccgccccgacgggcctccgagtccacgggttcaggcgtcccgtgcgtacggcgaatcctcctccggcggctgattcgccgtacgcacggcgccccggggtgttgctgccgtggcactcggcgtacgctggctggcgccatgccgtacgaaccacccacgcacaccgtcgagcgctcgctccgcgctaccaccggtgccaggaccgtcgccggtgtcgacgaggtcggacgcggtgcgtgggccggacccgtcaccgtgtgcgcggcggtcaccggtctgcgtcgaccgcccgaaggcctcaccgattccaagctgttgaccccccggcggcgcgccgagctcgctcccgtgctgcggagctgggtcaccgcctacgcgctcggcgacgcctcgccacaggagatcgacgacctcggaatgaccgccgccctccggctcgccgccgtgcgcgccctggaggggctgccggtgcggcccgacgcggtgatactcgacggcaagcacgactacctgggcgttccctggaaggtccgcaccgtgatcaagggcgatcagtcctgtatcgcggtcgcggcggcctcggtgatcgccaaggtgcaccgagaccggatgatggccgagttgggcgccgcgtccgaggactgcgccgacttcgccttcggtgccaacgcggggtatccctcgcccgtgcaccgggccgcgctggaggagcgggggcccacggtccaccaccgcctctcctgggcgtatctggacgcgctgccccggtggcagcacctgaagaaggtccgattttccgccgaggcggccgcactcgaaagcgggggccagctcggcttcgaattctgatcgcgcacacgcgcccctcctaccgacgccgacgacatcggcgtccgccacagaccaccttcatgcctctgatctccgaggagcctcagattcccgagagcgcccagggtccccgcgtcactccggccgccggccgcaccgcgccgaccccccgtcccgtacccggtccgcgttccgcggccactccgcgtcccggccgtccgggtcccggccccgcgcgccccgcgcc

SEQ ID NO: 4236 - DNA, 2034 bp, Unknown
  Kingdom: Bacteria, Phylum: Actinobacteria, Class: Actinobacteria, Order: Streptomycetales, Family: Streptomycetaceae, Genus: Streptomyces
cccggcaggtcagggcggcctgcggcagggccgccgcggagtccagcgggcgggcggcgaccatgcggcccagcgcggccggaaagagcaccgcctcgcctgccgccaccacccggaccgcctcggcgatccggcggaccgggaatcgtttgaggacgaagccgctggcgcccgcgccgagggcggcggtgacgtagccgtcgttctcgaaggtggtgatcaccacgaccttcggcgggtcggccgcttcggccagcagatggcgggtggcgtcgatcccgttgcgacgcggcatacgtacgtccatcaggaccacgtccggccgcaggctcagcgcacggtcgaccgcctcgatgccgtcggcggcctcgccgagcaccgagatccccggctgtgcggcgagcagcatgctcaggccgctgcgggtcacctcgtcgtcgtccgcgatcagcagggtgacggcgaggcctgcttccgcggggagggccaggcctccgtccgcctcggatccgttcacgccgaggtccgtaccggcagccggacggccagccgccagtgccccgtcccgtccgggccggacccgaactcaccgtgcagcagccggacacgctcggccagtccgggcaggccgtggccggacgtcgagaaggatcccggattcggacccgtccgcgctccggtccggttgaccaccgcgaggtccagcccgtccggtccggccgccacccggacctcgatggggccgcccgcaccgtggcgcagcgcgttcgtcagcccctcctgaaggatccggtacgccgcccgggagagcgtcccctgcacccgcgccaggtcacccgacagctccggttccaccaccgcccccgtgtgccgcaggcgttccagcagctcggggaggtccgccagggtccgggtcggcgccgttcccgactcctcctcgcgcagcactccgagcgcgtagtccaggtcctccagcgcggccctcgtcgagtcctcgatgctgcgcatggcggcccgcgccgcggccgggtcggtggagagcatctcgccggccaccgccgcctggatggtggccgccgtcagcgtgtgcccgatcgagtcgtgcaactcgtgcgcgatccggttgcgttcggccagcagcagctcccgctcggcagccagcgcgagccgttcggccgccgaaggacccagcaaccgcggcgccgaccaccgcagagttttcgtgaccagtacgcagatggccgccgccagcaggacgcacgcggcagccgccacccagctccacccgcccgacacccggaccgacgtgccgaacaggctcgcccgcgcctcgccgccgagccagttcgagggcagggagaggcccatgatgaacagcaccccgctcgccagcgcccccgtccacccgacggacgcgtgcagcaccagccagagcggggtccgccagcggtcgaggccgagcggaccggaggccgggcgaacggccgccgggttaggcagcgacacccgcagcaaccggcgggcggacacgaccagcgcccgccgtacgggacgcgccagtccgaccacgccgaccagcgccgcccacaccaccagcaccacggtgacctgcacgctctcgggtgcggatcgccacgacagcgccggcaacagagcgagaggcagcagcggaaggctcgccaacgcgccgcaataggcgaacagcacacccgagtacgtggagccgcgcagcagcagccgaattcccctgttcatgatcgtcagtatcgccgggcggctcccctgcggcctcccccgatcgggggagcgacttctcccgctttcccgcgatgcggtcaaagggccctggaagcaacgatcgtgcctcgacgaaacgacttcccaggagtggaaccatgcgtgttcggacaggacagaaccttcgttcctcgacccggcggaacggtcgggggcgacgaggctggtcggccgccgccgcgctggccgtcggcgtcatgacgctgggcgtcctcgccccgcccgccgcctccgatt

SEQ ID NO: 4237 - DNA, 1023 bp, Unknown
  Kingdom: Bacteria, Phylum: Actinobacteria, Class: Actinobacteria, Order: Streptomycetales, Family: Streptomycetaceae, Genus: Streptomyces
tcgccgccgaggtcgaagaaggcgaccgggcgcacccgcccgcgcgcgtccgtgagcagaagcgactcgacgaaccgcgcgaaaccgtccaggccgaccccgctcgtgtggtcgagcaccttgccgctgcgcagcggctgcacccgctcccggacgaagcgggcgtgctgttccgggttgacggactgccagcccaccccgtaccgctccagaccgccgtcggtgatctcggcgatcatctgggtcagcagatggctcttcccggtgctggactggccgatcatggcgaccgtcagcgggcggccgtgggtgaggtagggcaccgggatgtggtgctcggggaagtccgggtccgccgtgcactgctggaccgcgccccgcatgacgtcctcacgtcgcaccgggttgccgatacgggagaggtccagggcccggtactgcatctggtcgtccgtcacgtagagctcgctcaggtcgagttggatgccttccaggcagtacgggcagagcacctccccgggagcccggtcctcgggcgtcccgtccgccgcgtcatcggcgggagcgggcgtccgccgcttggcgtccagcgcccggtcgaacgcctcccggtgcgggctcgatccgtccgccgcgcccgcgggtcccagacgtcgcgcctcatcgggtgccagcagctccagcagcgccgcgggagtgggacgtccggccgccgtgggggcgaacgcgcggggcagggtcccggcgagcacccggtgacggtcgaggtcggcgggggcccggtcggcggggccgggccgaccggtcacgagctggtagagcacctgggcggcgctccacaccgcgtcccgggagtcgacgaggccctcgccgcggtactgctcgggcgaggcgaacggggcccggccccacggcgtccggggccgtccggcgcgggcgacgccctccagaccccagagctgcgccgacgtaccgtcccagagcacggtcgcgggggagatcccgcgcgaccgtgctctggga

SEQ ID NO: 4238 - DNA, 1133 bp, Unknown
  Kingdom: Bacteria, Phylum: Actinobacteria, Class: Actinobacteria, Order: Streptomycetales, Family: Streptomycetaceae, Genus: Streptomyces
ccccctgagggcccgcgccgaagacgaccaggcgcagccccccaccccagtcggcgagcgcgcgcagccggtccaggcaggccgcgaccgagacggcgggggtgcgcagggtcgtcagcgccaccccgtccagcagggccaccggcgtcagggtcgcgctgtcgtgcagcagatacgtggcgttgatccgccgcagcccgcgcgcggcgttgcccggcgcgacggtggcgatcttcacgccgaaccagccgccggactccgagggcatgagcagcccctgaccgtgggccagcggcacgaccgcccgcggtacgtcgccgtccgggtcgagccccccggccagggcctcccggaccgcggcgacggccccggccggaccgagcgcgaacacgtccgcggcgccgagcgtcaccgtcatcgcagcacgaacccgggtacgagggtgtcatccggatcgacggtgaagcggctcgttccggtggcgtacgcggtgcccgtcactgccgggacgaccgcggggcggccgtggaccgtggtggcccgctcgatccgggcgcggaagacggagcccaccaccgactcgtgcctcaactcgtcgccgaggcgcagttccccggcgtcggcgaggagcgccacccgggccgcggtgcccgagccgcacggggagcggtcgacctggccgtccgcgaacaccgtgacgttgcggtggtgcagcagccaggtgccgtcgggccgttcgacgggggcaccggcctcctcggtgaaaaccgtcccgtagacgccggacagccggtcgtccccggggtgttcggcggcgtcggcggcgttcagcgcgtcgcggatctcacggccggccgcgacgatcgcggtgacgtccctcggccggacccgcaggccgagccggtgtgccgggaccacggcgtacatggcgccgccgtaggcgatgtcgacggtgacggttccctgcgaggtggccacctcgacgccgcgtgcgtggacatggccgggaacgttgacgaacgtcacgtccgcgacccggccgccggtcgtgcgcacgctcgccgtgacccggccggaggggacgtcgatgacgacgtccgtcgtgccgtcggccggcgccgggacccggccgg

SEQ ID NO: 4239 - DNA, 2168 bp, Unknown
  Kingdom: Bacteria, Phylum: Actinobacteria, Class: Actinobacteria, Order: Streptomycetales, Family: Streptomycetaceae, Genus: Streptomyces
ccgcggagcggctaggatcctgccccgccgccggccccgcggtgcagccggtcgccgcccgccaggatcgccgaggccagcgcgtcggccgcctcctgggccgcgccccggcggttcccgggcagcaggacgaagtcgacgccgccgagctccggcagccccgccctggccggaaccggcgccagccccggcgggaccatcccccgggagtgcgccatcacccccaggcccgcccgtgccgccgcgaccagaccgctcaggctcgtactcgtacaggcgatccgccaggcccgcccgtgctcctccagcacctccagggcgcgggcccgggtgatggccggcggcgggaagacgaccagcggcacgggacgctccggatcgaggcgcagctgcggagcgccgatccagtccagcgcgtcctgccacatcagctcgccgtgggtgtcgccggtccgccgcttggccagcaccagatccagccggcccgccgagagctgccggtgcagcgtcccggacagctccacggtgagctggagctcgacctccggatggtcgcggcggaaggactccaggatctcggggagccgggtcagcacgaagtcctcggaggccccgaaccgcagccggccgcgcagccgggtgcccgcgaagaacgccgcggcccgctcgtgcgccgacaggatcgaccgggcgaagccgagcatcgcctcgccgtcctcggtgaggtcgacgcgatgggtgtcccgggcgaacaactgccgtccggccgcctcctccagtcgccgcacgtgctggctgaccgtggactgacggatcccgagcctgcgtgccgcctgggtgaagctcaacgtctgggccacggcgaggaaggtgcgcagttgggcggggtcgtacgtggcgtccatgaggccacgttatcgggaaccgtgatgacagtcagagcggtatgcgtgattcccgatggggaggcgggggagcaggatggtgggcgacaccggcccgctgcccgcacgcagggccgcacgacgcaggaccgcagggccgcacccgggcagcggcacgcgacgccgtccgcccggcacggccggccgacctctggagacccgagcagatgacccgccgcatcccgagagcgccgtcctggctgccggtcgacgcctacatcctggcgctggccgcgaccgtggtcctcgcggctctgctgcccgcccggggaaccgccgccgatgtggcgggtggggcctccaccggcgcggtctccctgctgttcttcctctacggcgcgcggctctccacggccgaggcgctcgacggactcaagcactggcgcctccacctcaccgtcctggcctgcaccttcgtcctcttcccgctgctgggactggcgagctacgggctggtgccgtacgtgctgacgcccgagctccaggcgggtttcctcttcctgtgcctggtcccctcgacgatccagtcgtccatcgccttcaccgcgatcgcccggggcaacgtgcccgccgcgatctgtgccgggtccttctccagcctcgccgggatccttgtcactccgctgctcgccgccctgctcctcggatcggccgggggcgggttctcggcggactccctgctgaggatcgtgctccaactgctcgtccccttcctcgccgggcagctgctgcgccgctgggtcggcggtttcctcacccggcacaagaaggttctcggcctggtcgaccgggggtcgatcctgctcgtcgtccacaccgcgttcagcgaggggacggtcgccggagtctggcgccaggtcaccccggcccggctcggcgcgctgctcgccgccgagggggtcctgctggcgctgatgctcaccctgagctggtacggggcacggcggctcgggttcggccgcgcggaccggatcgccatccagttcgccgggtcgaagaagagcctggcggccgggctgccgatggcaagcgtgatcttcggtgcgcacgcgagtctggcggtgctgccgctgatgctcttccaccagatgcagctgatggtctgcgcggtgatcgccaaacgccgctcccgcgatcccgagccgccccaggacccggcggattccgcttccggagcgttgtcggacccaccggttacggtgacccggtagccggtagccggta

SEQ ID NO: 4240 - DNA, 2410 bp, Unknown
  Kingdom: Bacteria, Phylum: Actinobacteria, Class: Actinobacteria, Order: Streptomycetales, Family: Streptomycetaceae, Genus: Streptomyces
atggagccgatctcgccggtgtggccgcctgcttcgtatccctgggcgacgacaacgtcgatgcccgcctcggcgtgccgccgggcgtgccgggcgctgccggccagcgcggcgacgaggatcccgtggccgtgggcccgttcgatgacgtcggcgggcggggagccgagggcgttggcgagaagcttgatcgggtagtcgaaggccacgtcgagctggccccgggcgacttcctccatccagccggtgatgcgccagccggacacctccccctcggccagttcgggcacatcgtggcgggccaggagttcccgcacgaatccgcggtgttcggccgggatcatcgcctcgacgtccgcctcggtgacgccctcgaccttcttggcgggcatgaccacgtcgaggccgtagggcttgccgtcggcgagtccgtgcaggcggtccaggtcgcgcgcgaggtcgtcgggagcggtgtagcgcaccgctccgagcacgccgaagcccccggctctggtgatggccgcggcgacctcggggaacggcgtgaagccgaagatggcgtgctcgattcccagttgcttgctcagctccgtctccatgggcggcaggatgccgcagcggagcggccgagggaagaccttttctgatgcagcgtcagattctttgcgggccgggacgcacccgggaacgcgggggtgacagtaatctctgcggcggcaggaactttcactgctcggcgagatttcggaagttactttcgcgcgggctccggcacacgggcacggcccggtgcccggacgccgggcgcgggaaggagttgcggatgaccggcaccacgaacggacgggcggcggacggccgggagggcgcgcacgaaggcccggagcgggccggaggccgcggctcctcgaccgaggcgcgcgcggccgggagcggcatcgcccggcggcgggtgggcggcgggatactggcgctgggcggcgcactcgcgctcacgcccatgccactcgcgggcgcggccgcccggagcgggccggacgcggggacggcggccggagcggcggacacgggagcgggcatgaagtcagggtcgcaccggcccacactgcggcgcgggagcgccgcacgcgccgggctgctccagggaccgctggaccagctcgtccgggacgcggaagcatatctggcggactcccccaagcacccctggtacgcgggtgcggtcctgctcgcgggacggggcggcacggtggcgctgcaccggccgatcggcaaggccgtgcgctatgccgcgtacgacgagaagaccgacaccggggtggagttcccggcggaccagcagatcgcgatggccgaggacaccgtcttcgacctcgcctcgatctccaagctgttcacctccctcctggcggtccagcagatcgagcgcggcgcgctggagctggaggccacggtcgcctcgtatctcccggacttcgcgggaggcggcaagcaggacgtcacggtccgccaactcttgacgcacacctcgggtttccggtcgtggatcccgctgtacgaggagccgacccgggagggcaagctccggaggctgtgggaggaggtcccggcgagcaccccgggcagcgcgtacctctactccgacctcaacctgatctcactgcagctgatcctggaggagatcaccggccgcccgctggacgccctgctccgcgacgagatcaccgccccgctcgggatgcaccgcacccgctacaacccgcccgcctcctggaagccgaagatcgcggcgaccgaggacgcccggctgccctggtccggtctcgagcgcggactggtctggggcgaggtgcacgacgagaacgccttcagcctggacggggtggcgggccacgccggggtgttctcctgcgcctgggacctcgcgatcctcgcccggaccctcctcaacggcggggtctacggccgcgcccgcatcctgtccgagcaatcggtcgacctgctgttcaccgacttcaacaccgcgttcccgggcgacgcgcacggcctcggcttcgagctctaccagcactggtacatgggtgcgatggcgaccccgcgcagtgccgggcacaccggattcaccgggaccagcctggtgctcgacccgtcgaccgacaccttcctcgtcgtgctgggcaactccgtccatcccgtacggagctggcgctcgggcagcgcaccccgggtggcggccgccaaccagctggcgcgggccgttccggtccggcccgaacgggggcgtacggcctggttctccgggatggcgagcgcgtccaccgccaccctcaccctgcccgccctgcgcctgaactccgcacgggccaggctggagtgcgcgctgtggtgggacaccgaaccggccgccgac

SEQ ID NO: 4241 - DNA, 1471 bp, Unknown
  Kingdom: Bacteria, Phylum: Actinobacteria, Class: Actinobacteria, Order: Streptomycetales, Family: Streptomycetaceae, Genus: Streptomyces
ctgcatggccctggggcgggcggccaggctcccccgccccagggccatgcaggggggcgtgaccgggaacccgagcgcccccgcaccccgcggcagaggcccaacaccacccggacaaaccctccgtgacggtcccgcacgctcccgcgatccgtcactccccttgcacaccccttgatgtgacgtgcacatgtcgccactctgttacctgacgcccaccccacagaaacctggcgtcgccacgatggccgggctcactcacgcccgcccaagcaccccccacatcaagggagtcagcatgtccggtgtctacgcgcgtcgcctttccgtcgtcgccgcaaccgccgcgctcgccgccacgtccgccctgttcaccgccccgagcgcgcaggccgccatgcccaccccggtcagcgcggcgaccgcacgcacctacctcggccagctcaccgtcggcgcggagggctcgtccagcggctacagccgcgacaagttcccgcactggatcacccagtcgggagcctgcaacacccgtgaggtcgtcctcaagcgcgacggcacgaacgtccagcaggactcctcctgcgccgccgtcagcggcagttggttctcgccctacgacggtgccacctggagcgccgcgtccgacgtggacatcgaccacatgatcccgctcgccgaggcctggcgctccggcgcgagcagctggaccaccgcccagcgccagtcgttcgccaacgacctgacgcgcccccagctcatcgcggtcaccgacaacgtgaaccagtccaagggcgaccaggacccggccgagtggatgccgccgacctcctcgtacaagtgcacctacgtccgcgcctgggtccacgtcaagaagcactacaacctgaccgtggactccgccgagaagagcgccctgcagtccgccctgaacggctgctgaccaccgcgcgcggccgctgactccccgacgcccactccccccgcagggccgccggcccaccggaacccgtgcacactcctcccgcgttctgtacgttacggaccccatccgtgacggcgtcgcgaggagatatcacatggccgggctgcgcctgggaccactgctgcggtacgtcgactgggggtccgggtccgctgcgaccgtctgggtcgaggcgagccgtccgtgcaccgtggaggtccggtgcgcggacggcgcctcggggacgtcgcccaccttctcggtggccggtcaccactacgccctggtcgtcgtgacgggtctgacccccggctccaccacggcgtacgaggtgctgatcgggtcccggcgcgtctggccgcccgacgacgcccgcctcccgccgagcaccatcaccacgccgtcggcggcggttccggagggcgccggggcggcggagccggacggggtgcggatctccttcgggtcgtgccggtgggcgtccgcccccggcggcgggcacgaccc

SEQ ID NO: 4242 - DNA, 2266 bp, Unknown
  Kingdom: Bacteria, Phylum: Actinobacteria, Class: Actinobacteria, Order: Streptomycetales, Family: Streptomycetaceae, Genus: Streptomyces
ctcggcctcgatgccgtgccggcaggcctcggtgaaattctcctcggcggcctcgaacggcagcctgctccacaccggccgggactcctcggcgagcgcccgtaccagcccgtagtagaaggcggcgttggcgatcacatcggtgaccgtcggcccggcgggcagcacccggttctccacgcgcagatgggggacgccgtcggcgatcccgtacaccggacggttccagcggtagacggtgccgttgtgcagcaccagctcggccagtccgggcaccccgccctcgtccagcaccttcagggggtcctcgtcgtcgcagatcggcagcagcggcgggaagtagcgcaggttctcctcgaagagctcgtgggcggagccgatccaccgctccccgaaccaggtcctggggcgcacgccctggttagccagctccggcggccgtacgtcggtggcctgctggaacaggggcggccgggactcccgccacagctccttgccgaagaggaagggggcgttggcccccagcgcgatctggacgccggtgatcgcctgggcggcgttccacacgtcggcgaaccgggccggcgtcacctggaggtgcagctgcaccgaggtgcaggccgattccggagcgatcgagggcgaggtgcagaccagtcgctcgacgccttcgatatccaggacgaaatcctccccccgggcggccgccatttggtcgttgagcagggtgtagcggtccacgtccgagagattcgcggacaccacgtcgtgctcccccagggtgggcaggattccgatcatcacgatccccgcgtccacctcgcccgccttgcggtgcgcataggcgaggccggtccgcaactcctccgagagctgatcgaatacccggccgccgaggcggtgcggaacgatattcacttcgagattgaacatccccagttcggtctggaaatcccggctcgcgatgcgctggagcacttgctgattcatcatccggggcatcccgtcggaacccgcgagattcagctctatctccagccccatcagattccgcggacggtcgaacctccgctccgccaggagtctgcccagcccctccaggcactggttgagcttggtgcggtacgcctgtcgatcggacaggtcaacggcttccgccacgaccttctcccccatcgaggggtccctcctccagtgggcggcccgcggcccaggccgctcgcatcacgatcgataatgcccagcggaagtgatccgtaacgcccccacgggcctccgttacccgatagtctggtcgaaggagaccgggggcacattccggcggcatgtggttccccacattttcggccggagtatgcacggtgaaaacaccgacgcgtttcagccgaccgctccgccggaagggtgccaggtcgggatcgtcagcggcagttcacatcaccagaaataccacaattcgaagaccggatgacgccttgcgcgacatatctccgaccgctagtggaaacactgtgtgaacacgcgtcatataaactccgctcaacgaggcagagcgtcgatacgactcgcccgtcaccggccgtctccggccttcatgccgacagcgccgtctgcacccgcccaagcgccaccgtgtctccgaagtgagaggcgacccactatgccgctgcatgttcccccggctcccgcgcccgccctgcgcagtgttctcgcggccctcggttctcccaccgccgtccgcgaggcccgcacgtccgctctccggtccgtccagggaccgctgagccccgaactaccgcttcccgtgcatgtgctggaccggatcgcgcccgcccggacagcacctctgacacgcctcgcggcctggcgtttcctgatccggagcgagggccgcgcggtcgccgcggcggacaccgtgctcacccccgacggctggaccttctcgcacttcttcgaggggccctacctcgcctcgaccgagctggccgtccggcaggcgggcgcgtcggccaccgcctgccaggcgcggctgctgtccatcccggagctgtacatgctcaccctctggctgcacggcgacaccgaggccgatcccgccggcggggtgctcgcgccgacggacgtcctggtgcccctggcgccggccccaccgggcatcgccgcccaccgcccgtaccgggtcgccgatctgctgcccgtcatctcgctgcgcgtggcccccggcccgctcctcagctcggcctgaccggcgccaccccggcagacc

SEQ ID NO: 4243 - DNA, 633 bp, Unknown
  Kingdom: Bacteria, Phylum: Actinobacteria, Class: Actinobacteria, Order: Streptomycetales, Family: Streptomycetaceae, Genus: Streptomyces
cgccgggccggcgcggtgcgtacccctgcggcagcgacgtagcgggaagctcccggctctcgcggtcctcccggtcctcgccgccgtcgtcctccgcgtactcctggacgtccgcgtactcctcgacgaccgcgtagccgtcgccgtcctcgccggacccgtagctctcgacggccgcgtcttccgcttcgctcctggcaggcgggagcgcgtaggcaccgcccagctcccccggcgtggcgggctcgacggccgggatgccgtacgtcgtggggccggccaccgggtcggcgtcgggcgccggtccgggggcgtagccgcagagcgcctcctcggctgcgcccgccgcgagaccggtgagcatgacacggccgtcgtcgcacaccaggaccgtgcgcacggtgatgttgcggtgggtccagccgtgggcgtgcagcacccgcagcgcggtgagcacgtcggagccgatctcggccgcccggtaggggttgagggggcgttcggcgaggagggcggcgagcgggcgggccgcgacgagctcgctcactatccacagcgagcccgcttcggcgaacacgtcgaagacctggtcgagccgggggtgatcgggcacctgggcggcggcctgcgcgg

SEQ ID NO: 4244 - DNA, 1289 bp, Unknown
  Kingdom: Bacteria, Phylum: Actinobacteria, Class: Actinobacteria, Order: Streptomycetales, Family: Streptomycetaceae, Genus: Streptomyces
gtctcagctttccgtcgcctcggccagcagggcttccgcctcgtcgcgggcgtgggcgacggggtcggggaaaaccttcaggccgtgggcgaccagcgccccttcgtgcagcagcatgagtgtccgagccagccggtccgcgtcggggccgaggccctcgacaccccgggcgagccgggtgaacaggtccagcgtccactgcttctggccggtgatgaccgcgtgcgccgggtgggacgggtcgctgatctccgcatgggcgttgaccatgctgcagcccttggagccgttgtccgacatccaggcgcgcgaggcctcgaagacggccaggatccgggcgcggggcgcgggcggcgcggcgtcgaggcgatcggcgaggaaggcgcgccagcgttcgtcgcggtcggcgaggtactccacgacgatctgctccttggagccgaagcggtcgtagagggtcttcttggtcaccccggcctcggcggcgatcagatccaccccgacggcgtggatgccccggtcgtagaagagccgcccggccgccgccagggcccgtcgcgcggcaggcgtcatggtgatccgtcgcagctcctccgaagtacccatgaccacgagtataccgatctgtatagtcgagagcaggtataccgatctgtatagcgaggtgcgtcatgaacgtcctgctcccggtcgccttcgtgctgtgctggagttccgggttcatcggggccaagctcggcgccggcagcgcgtcggccctcacgatcctgatgtggcggttcctgccgctgacggtcgtcctggccgtggtcgcggtgaccgtcgcgcgggcctcctggcggggcctgggagtacgggacgtgacccggcaggccgtgatcggcgcgctgtcgcagagcggctatctgctgaccgtctactacgcgatccagctcggggtctccacgggtaccacggccctgatcgacggggtccagcccctggtggcgggggcgctggccggaccgctgctgcggagtcacgtcaccgcccggcagtggctcggcctgtgcctgggggtgagcggagtcgtcgtggtcacgacggccgacgcctcggccgccgccgccggggtggccgggtgggcctacgccctcccgttcaccggcatgctgtcgctggtggcggccaccttcctggagagccgttccgccacccgggtggccccttcggtgtcgctgaccgtccactgcgccgccagcaccgtgatcttcaccgtgctcgccgtcggcacggggaccgcgctgccg

SEQ ID NO: 4245 - DNA, 511 bp, Unknown
  Kingdom: Bacteria, Phylum: Actinobacteria, Class: Actinobacteria, Order: Streptomycetales, Family: Streptomycetaceae, Genus: Streptomyces
gcgcggggccgccgggtcgcggtgctcaagccggcgcagaccgggctcgcccccggggagccgggcgacgcggtcgaggtcgcgcgcctggcggggagccatgtgacggcggtcgaactggcccgctttccggagccgttggctccggccacggccgcccggcgggcgggactcgtgcccgtgcggcctttcgaggtcgccgaggccgcggagaaactggccaccgagcacgacctcgtcctggtggagggtgcgggcggactgctcgtacggttcgacgacgagggcggcacgctcgcggacgcggcccgtctgctgtccgcgccggtgctgctggtggcccccgcgggcctgggcacgctgaacgccaccgcgctgacggccgaggccctgcggacccgggggctgagctgccggggcgtcgtgatcggcagcatgccggcggagcccgacctcgcgtcccgctgcaacatcgaggacctgccggtggcggccggcgcaccgctgctcg

SEQ ID NO: 4246 - DNA, 1067 bp, Unknown
  Kingdom: Bacteria, Phylum: Actinobacteria, Class: Actinobacteria, Order: Streptomycetales, Family: Streptomycetaceae, Genus: Streptomyces
ggccaccgcggcggacgcggcgcccgagtccgcagggcgacgacgccggtggcccggccggctgctgctcgccgtcgccgtcctgtgggccctgttcgtcgccgcccgcgccctcctcagcggccggtggtgggcgtggaacggcctcggcctcgccccgcccgtcctccatctgctggtcccgctcgccctgttggtcccggccgccctggtccggcacggcaggcgggcggccgtcggcgtcgtcctggccgcgctgctgctcggctcctggcagaccggactgcaccccggggcgctcctgcgtggacagtccgccgtgcccgccgacgccctgaaggtggtcagctggaacaccttcttctgggaccaggacagcgacaccgacgcgttctacgcctacctcaaatcccgctccgccgacgtctacctcctccaggagtaccagaacgcccggggtgacgaacccgcgccgatcgacgacctcgtccggctgcgcaaggagttccccggcttccacctcgccaccgagggcgagttcctcaccctgtcccgcttcccgatcacctcggtgcgggcgctgcgcccggacggcctcgcccggcccgacacctcctgggccgactactggaacatccgcgtcctgcgcaccgacgtcgacgtcgacggccggaccctgtccctctacaacacccacctgcccgatctgctgaacgtcgaccgcaatccgctgacccccgcctaccaccgctccgtacggcagctctccgagcgccgcgacaggcacttcgaggcgctgcgcgaggacctcgacgccaacggtcacccggtggtcctcgccggcgacctcaacgtgctgccgggcaccggcgacctgcggtggttcgacggactgcgggacgccgccgacgcgggggactcggtgtacccggcgaccttcccggtcggcggaccggcgctctggcggctcgactgggcgttcgtctcgccccggatcgacctgcaccggcagtccgtccaggacccgcccgccgcactctccacccaccggctgatcgatctgcgcc

SEQ ID NO: 4247 - DNA, 871 bp, Unknown
  Kingdom: Bacteria, Phylum: Actinobacteria, Class: Actinobacteria, Order: Streptomycetales, Family: Streptomycetaceae, Genus: Streptomyces
gaggagttcggggcccgcgaggacggcgcagacccaggtgccatccaggggaacggcccggcccctggcccgggaggcggccaccgccgggatcggctgcggcagtggctcggtgcgggcgcgggccagttcggcgccgtccgcgtcatggatgaggatcccaccgtccaggatgtcggcgagggccgccgccacatcgtcggcgccgccgccctgcaggacgaggtcggtgagctggtcgtgcgcctcctcggcgcggcgcatcgcctcgctgtgcgtccggatggtctccgacgcggcgttgaggtcgaccagcgcggcccgggtctcctccagcagccgcgccccgtcgatggcgatggcggcgtggtcggccagggacgagagcagcgccacctccgaggcggtgaactcgcggggggcccggtcggccgcgtacagcactccgatgacgcgggcgcccaggcgcagcggcacaccgaggatcgcccgcaggccctcgtccaggacggcactgtcgatggtggtggtgtggtggaagcgggggtcggcctggtagtccccggtggcgtacgggcgggcggtctgggcgaccagcccgcccagaccttcgcccatgccgagccgcagccgctggaagtcctcggccacggacccgtcggtgacccgcatgtacgtgtcacccgcggcgtcgtcgttgagggagaggtaggtgacgtcggtgccgagaagcagtttcgcccggtggacgatggcccgcaggacggcgtccagttcgcgcagggccgccaggtcgctggccgtgtcgaacagggcggtgagctgcgcctcgcgcacccggtgctggccgagggtgcgcgaggcgcagctc

SEQ ID NO: 4248 - DNA, 1118 bp, Unknown
  Kingdom: Bacteria, Phylum: Actinobacteria, Class: Actinobacteria, Order: Streptomycetales, Family: Streptomycetaceae, Genus: Streptomyces
cggggcggccgtcggccgggcggggtccgagggagggtccgccgccggggtctgctgggttctgccggtctcactgctcacccgacgagcgtatggcccccgccgccgccctggagccggggctcctccgtaccgccccggccgtccttcaccgcccccgcctccggtgggtccgcgggaccgtgcgtagggccgggtgctccgggcttccccggcgtacgcgaccggccgggaagcccagagagcagccgccgcccgccgatcgtggcacgggtgcccagccacacgaggaaggccgtcggcaggaacaccgcgtcggccgcgatcatcgccatggagaagaacggcagtcccagcagcagggcgatccccgcgtgctcgcagatcatcgcgaccagcaggacgttcttgacccgccggttgaacagcgtgaacggaaaggcgacctgcacgatgaccgtgccgtacgtcagcaccatcaccatcagcccactggcgcccaggatgtccgacagggcgggccacggggtgaagtagtcgaggttgagcgggtagtagagcgcggtgccgtcctgccaacgcgatccctggatcttgtaccagccggcggtcgcgtagatcaggcagacctcggccatgatcacggcgagcgtggcgttgtgcgtgaggttggccagcacatcgagcagggtgcggggctcgccgtgcggcaggtagcggttcacggcccaccaggcggcggcggagagccagatcgtccacagcagagcggggagccaccaggtgccgccgagcccgcccatcagcgtggccgccacgaggacggggccgagaagcacccagagcgccgggcccacgatgtcccgcagcggcggcaggcccgccgcggcgcgttgcgcgccgcgcgccgcgcgccgtgcgtccagcgaccagacctgggcgcaccgcgtcagcaccaggtagatcgccatgaggtggacgacgttgtctccgccgtcgcccatgaagatgctgcggttctgcaccgagagcacgccgaccatgaagaggacggacatggtccgggtccgccatccgagcagcagcgccgccgcggacaacagcgtgagggcgtacac

SEQ ID NO: 4249 - DNA, 976 bp, Unknown
  Kingdom: Bacteria, Phylum: Actinobacteria, Class: Actinobacteria, Order: Streptomycetales, Family: Streptomycetaceae, Genus: Streptomyces
gccgcgcacacggcggacggctggttccgcacgggggacgtcggcacggtggacgaggacggctacgtcacgatcgtcgggcgcaaggccaccgacctgatcaagagcggcggctacaagatcggcgcgggcgagatcgagaacgtactgctcgcgcaccccggggtccgggaggcggccgtgaccggcgaggaggacccggatctgggcgaacgggtcgtggcctgggtggtggccgccgaccccggctcgccgccgcccgccgaggaattggcggaccatgtggcggcccagctggccccgcacaagcgcccgcgcaccgtgcactacctggacgccctgccccgcaacgacctgggcaagatcatgaagaggtcgctccatggccgctgactcccccgcccgggcgacggcccgggagacgatcgcgctgctcaccggcgcggcgggcttcaccgagcaccgcccgccggcgcaccccctgccgccggacggtccgctcggctgggcggggtacgacgcggcgcgggcgcgggccgggacacggaccggcgaggaggagtccgtggtgtacggcaccggggtcgtcggcgaccgcgcgtgcgtgctgctcgccttcgaattcggtttcctgggcggctcgttgggccggctgacgggtgaccggctggcggccgcgtacgagctggccctgacccggaggctgcccctgctcgcactcgtcgccaccggcggcagccggatgcaggagggcatggtcgcgctcacccaactccagcgggtggccgcgcgcagccgggtggaggcggcagccggatgcaggagggcatggtcgcgctcacccaactccagccggtggccgccgcctccacccggctgcgcgcggccacccgctggagttgggtgagcgcgaccatgccctcctgcatccggctgccgccggtggcgacgagggctagcaggggcagcctccggg

SEQ ID NO: 4250 - DNA, 1520 bp, Unknown
  Kingdom: Bacteria, Phylum: Actinobacteria, Class: Actinobacteria, Order: Streptomycetales, Family: Streptomycetaceae, Genus: Streptomyces
gggcggggccgtgcggagggcggcggcctcggtctccacgtgggccagggccaactcgccggcttctcgcgccacttcaccgagcagccgacgagcctgcccggcgtcaccggcaccagcaccggcaccctccgtacgggctgccccggcacgggccgccccggcaccgacaccctccgtacgggccgccccggcacgggcgagcagggaacgggccaggcacagccgggcgcgtacggcccaggggcgggcgccgagacggtccgaggaggcggcggcctcggtgagcgccgccaccgccgcgtcctggtcgtcgcgcgcggcggcgagcatgccgagccagaggtcgacggggccgccgatgtcgcacccgtacagcgagacgatccactggcccgtgtagggcgtcagctcgtcctccgcgcgggtgatgagccgtgggtcgcccgtgatcgcggccgtctgggccagcagccggagccacagcggcaggaatgcccgagggtagggggcggcgcggtccgcctgttcggcgatcagacgcagcgcgggcgtggcgtccccctgctccaccgcggtgaccgcctccagcaacccggggtagggatacccggcgccgggaagcaggccgaggacctcctcggcctcggcgaagtgcccctggagcagatgcagcgcccagcgcaggtggtgtcccatgaagccgaaggccacgtggtcgttgctttcggggtcgagcgcgtcgtcctccagcgcggtggacgcctcggcgaacctgccctgaaggccggcgatcaggctggtgtccacggcgattcccagggcgaaccggggcagctcggtcagctcggcgagccggacgaacgcccggaactggtcgatgaacgccgggtcgcccagctccagcagcgccacccagcgcatggacatcgcgtgcagctccatgtcctggtgctgggtgcgccggccgacgacagtcatctcgtcggtcagcccgagccgctccatcgccgagccgaggccccacacggagtcgtggcgcgcccagagcgagaaggcgagcgcctcgtcgtccgagccgttccgggccagcgccatgatgtggatggccagctcctgggcgagccggtcgtcggagaggctctcctggccctccttgccggtgaccctgtggtgggcctcggcgaggagccccatcgtgggcacgtcgtggccgcccagggaaccgtcgcggtggagggtgatcgccacccgggccagcagctccggttcgtccagctcccgggccagggcgaccgaccggtccagcagccgctgcgcctcggccgtctcccccgtgtgccggagctgaccggagaggtcgagaccgatcagcacggcacgccggaggtccggaccccggccctccgcgtccaccgcgcccggcccgtccaccgcgcccggcccgcctgccacgcccggcccgcacgccggagctccccccgacgctcctccaggagactcctgcggcctccctggtc

SEQ ID NO: 4251 - DNA, 987 bp, Unknown
  Kingdom: Bacteria, Phylum: Actinobacteria, Class: Actinobacteria, Order: Streptomycetales, Family: Streptomycetaceae, Genus: Streptomyces
gccctcggggggccggggagccggcctggtacgccgggtcgtcacggccttgcgggcggtggcgaggggtcgcgggcggacaagtcgcagcctggagtcgcgcggagtacgggacgtcacgggagcagtcttgctcctgacggcccgaaagcccaaacggaaggcgtttcaccggtacgggaaaggttcccccggcgcggcggcaagcgggagagttcaccccatcggctcacatcaagggcgtgaggaagcgtcgcagggtctcctcgtagcgggccgggccggcgttccacatcgacgcatgcggagcctgcggtacggcgtggaggctgaccagctccggacggcgggcggcgagctcgcgggaggcgccccagggggcgatcgtgtcgtccgggccgtgcaggatcagggtcggggtgcacagggaggccggcaccgaggtctccagcaccggggcgccgttcatcccggtcctgccctgggccgcgcggacggcgagcggcaacagggcggccgggacgccgcgggccgccgccagggcacgcagggtgaccggccagtccagcaccggggagtcgaggacgagaccgctgatccggtcgcggagcggggactcgaccgcggcgtacagggccatggtggcgccggtggaccagccgtggacgatcacgttgcgggccccgctgcgcagggcccagcggagggcggcgtcgaggtcgcgccactcggaggcgccgaagtgaccgaggccgtccgcggggcggggggctccggggtcgccccggtaggcgaggtcgagtacggggaagcgctgttcgcgcaggaaccccatcaggttcatggggtgggcccgggtggtgccgaggccgtgcacggtgatgacccaggtgtcgcgcgcgccggggacgtaccaggcgggcagggctcccaactcgccggggatctcgacctcctggtggtccagaccgaggtcgccggccgggt

SEQ ID NO: 4252 - DNA, 568 bp, Unknown
  Kingdom: Bacteria, Phylum: Actinobacteria, Class: Actinobacteria, Order: Streptomycetales, Family: Streptomycetaceae, Genus: Streptomyces
cgtgggccaccccggcgaacttgtcggcgccgctcaccgcgaacccccggcacagggcgccctgttcggcccccaggatgttcacgcagaacgccccggcgcgggcgatgcgcggccaggtcgtcgacgtacgggcgaccatgaaggacaccagcggcgggtccagcgacagcgaggcgaaggactggcaggcgaagcccgcggggccgtccgcgtcgcgcgcggtgatcacggtgacaccgctggcgaagtggcccagcacacgccggaactcgtccggggcgacgggcagtcgctcgtcgtcccggacggctctcaggtcgggccggggcagcgcctcgggcggcgtccccggtgcggctgtcgtggcggcgccgacggacctgaggtaccggacggcggtggcggccatgcctgcgtgtcccatcacgccgtccattagagctgacgctgcgtcagatgtgaagcctgcgggaggccggtccggggtggtccgggtgtcaggacccggagcgtcgggcgtagtggcgctgcgccttcgcgcggttgccgcagcccgccatggagc

SEQ ID NO: 4253 - DNA, 1804 bp, Unknown
  Kingdom: Bacteria, Phylum: Actinobacteria, Class: Actinobacteria, Order: Streptomycetales, Family: Streptomycetaceae, Genus: Streptomyces
gtcctgcggcgctccgaacccaccggagggcggaccggcgggcgggggcgtgttcggcggctgctgcggtggctggggcggctgggtcatggcgtgcgtacctcgggagacgagtgggagtgggggcgcgtgggagcgggagaggccggctgcggtcggatgccgtggcgaaccgtcacttggtgaacaccagcatcgtcgactgctccagctcttccttgtcgttgctcgcgctcacacgcttgctgaagatgtaggagcggccgccctcgtagaggaccttggcggagaagaagccgttctcgatccggccggtcgactccgggtgctggagcagcgtcttgggagtgccgccggtcggcgggagtgtgacgagtgcgccggcggcgtcgtacttcggccgcatgtagagcagcacgttgccgccctccatgcccagcggcttcagaacacgctcggccggggcgggcgcctcccacttgggcttgcccgtgttcaggtcgaaggcgatgaccttgttcgtccgggcggtcccgctgctgtcgtcctcggtcgcgatgtagaacgtgttggcgtcggcggcgacgccgctgcacccttcgagcttctcgccgaagatcgcgaagctgcccccgcagtcgacggtgagcttgtcacccttggcgggcgagagctgcgagcggagcttgccgctctcggtgagcgcggcgatggcgtactgcttcttctcttcgtggtcgaacctgacgacgagcgggctgaccgagtagaccttgctgacctcccagccgcgcgcgggctggtacgtccacttggccttgccggtggccgggtccagctcctggacctggtgctgcgggttcttgacgtcgtcggtgcggcagctggccgcggcgatcagcttcgcgccgccggcgaaggcgaagggcttgcagttgccctccgggttgccgaacagttccttgccgtcgctgacgcggtaggcgttggagttgctggtgcgccccaccgtgacggtgtccccgctgatcgccagaccgatgtccgacaggaagtcccaggtgccgttcttcttgaccgatttcttccagccggccttgccggtgttgaggtcgatcatctggaggacggagcagtcggaccggtcggtggtgccgtccttcacgccgatgacgagcttgccgtcggcggtcgcggtgttgggcgtggcgcacacgtcggcggggagctccagggtccacttcttcttgccgtcggtgacggagtagccggcgacgccccggtacatggccttgacgaccaggtcgccggtgaaccaggggccttcgacggacgcgccgctgcgcggcaggtcgacgtcgttcttctggagccaggcgaccttggcctcgcccggcttgcgcccggcgttgaggtcgctgtccgcctcgcggccgtcgccgttgccgtcgccctcgtcgaccgtcggcgacgcgctgggcgccttggggtcggtgctcgggccggcgacgggcttcttggggtcgtcgccgctgtcactcacgaggaaccaggtgcccgccccggcgaccaggaccacggcgagcgccgccgcgaccacgatgccggtcttgttcttgaggaacccgccggcgccggaacccggtccgccgggggcggggacgccggggtactgctgctgcgtcgggtagccctgaccggggtggggctgctgaccgtacggacccggagcctgctggctgtagggaccgggctgctgaccgtacgggccgggtgcctgctgaccgtacgggccgggtgcctg

SEQ ID NO: 4254 - DNA, 980 bp, Unknown
  Kingdom: Bacteria, Phylum: Actinobacteria, Class: Actinobacteria, Order: Streptomycetales, Family: Streptomycetaceae, Genus: Streptomyces
cgggaccggatgcggccgggcgcggtcagcggctgacatgccgccgcaccgcaccccggccgcatccggtcccgaccgcctcgaccgcctcagacacagctacagctacaccccagccgtcagaggctgatgtggtacgccttgcggagcgtctcgtggacggtccaggtcgtccggtcgccctcgcgcagcacacaggcgtcccccgggccgatctccagcgtcgccccgccctcgaccgcgacggtcgcccggccgctgacgaccacgaacaactcgttcgcctcggtgtcggtgaccacgccgggtgtgatctgccagattccccggatctgcttgccgtcggccgcttcccacagcaccttgcccgtcaccacgggatcgcccgagacgatctgcgccggatcgaggggttccggaacgagttcggcgtccgggacgtgcacggcgaaggaggcggggacctggtcgtatgtcgtcatggccagtcaccttagcgatcacttccggccgcccggcggccaggacccgccacaggatgtccgtccgtggtttgtacccctcccggccgcgacagggatggggcatgcctcagaacccaccgcaccagcgtcccgcggatacgaagaaccctgagacgaacgcctacgaaccggtgctctcggcggaggtgcgcgcggcgttgagcgccggtccgcccgtggtggcactggagtcgacgatcatcgcgcacggtctgccgcgcccccgcaacctctccgtggcccgggagctggagggaatcgtccggtccgccggcgctgtcccggccaccgtcgccgtcctggacgggcgggcccatgtcggcctgagcgaggaccagttggagcggatcgccggagatcccgcagttcgcaagctggggcaccgcgatctcgcgccggcgctcgccgccggtgccagcggggcgacgacggtgtccgcgacggcgttcctggcgg

SEQ ID NO: 4255 - DNA, 1241 bp, Unknown
  Kingdom: Bacteria, Phylum: Actinobacteria, Class: Actinobacteria, Order: Streptomycetales, Family: Streptomycetaceae, Genus: Streptomyces
cgtacgcgtacgggtcgcacgcgtacgggaagcccccggcgaccacgggaatccacgtggtcgccgggggctttcgcgcggggccggagaggcgtggctcacgtcccggggagcgcggggcgggtgatgacgatcatggcggcgtcgtcgttcaggcgtccgccgacgtggcgcagcaggtcgtgccggaagcggtcgaggaaggcgtcggggtcgctctcgctccagccggtgatgcggtcggtgagcgggtagaaggcgccggtggcgtcgcgggcctcggtgacaccgtccgtgtacaggagcaggaggtctcccggctcgaacgggaagctgtcgacgtggtagcgaggttgcgccagttcgcccaggcccagcgggggcgcggggcggcggatgtccgtcgtcgtcggccggccgtcgcgcaggacgaccggcggcgggtgcccgcaggagatcatccggaccgggccgtcccggtcggggatgtccaggacggtggcggtgatgaacgtttctccgaagcggccggcctcgcccggttccatcaggtcccagcacacactccggtcgaggtaggtcaccaactcgtccaggtccgcccggcggtgggcggcgacgcgaaacgctccgagcagcagggcggcgtcgttgaccgcggtcatccccttgccctggacgtcgccgacgatcagccgggttcccgaggtggtgcgggccgccgcgtacaggtctccgccgatccgggcctcggcctcggcggcgaggtagagagcggaggcgcgcagggggccgagcttcctcggcagcggcggcaggaccacgcgctgggcgacctcggacacgtaccgcacctgcgtcagctctttcgcgtgacgctcccgcaggacgcagaagaccaccaggctcgtgccgaccaggatcagggcgatgatctgtgcctcgtggttggccgagagcagttcgtcggggtcgcggagcaccccgatggccgtctgcgcgacgaccgccagcgcggcgaccaggcccacggtccggggcccgccgaacgagggcgtgaccgccggggccgcgacgagcagcggaccgagatggatgtcgggcggcgcgagaacatcgatcaccgacaccgcgacgatccacccgatcgggatggcggccagcgcccaccgggggcggggtcctgcacggcgctgggacatgcctcctctctacaccgccgccgtacggtccgcaccggc

SEQ ID NO: 4256 - DNA, 522 bp, Unknown
  Kingdom: Bacteria, Phylum: Actinobacteria, Class: Actinobacteria, Order: Streptomycetales, Family: Streptomycetaceae, Genus: Streptomyces
ccggtcctgccgggccagccagtcgaggtgctcgcggaactgtgcgggcagggcgagcgatgatccgtcgcccccgagtgcgtacagctcgaacagctcccgtacgagcacgggaaccgaccaaccgtcccacaggaggtgatggttggtgaggacgagacggtggtgacggtcgtcgaggcgaatggccgtgaagcggagcaggggtggccgggccggatcgaaacggatggcccggtcctcgtccaggatgcgggtcgcctcggcctcccgttccccggcggcgagtccacggaggtcgcggtccgtccaggggacctcgacgtcggccggtatcacctggacgggactgcccgactcctggttcacgaaggccgcgcgcaggttgggccggcgccgcagcagggtcgtggcggaccggcgcatcgcgtcggcgtcgaagtcgccctccaggtcgaagacgagctggatcgcgtagaggtcgggcgactcgctgtcgtacagggcgtggaagtggagtcc

SEQ ID NO: 4257 - DNA, 681 bp, Unknown
  Kingdom: Bacteria, Phylum: Actinobacteria, Class: Actinobacteria, Order: Streptomycetales, Family: Streptomycetaceae, Genus: Streptomyces
cccgtctcccccgcctcgcccgcttcctcgccctcctccttctcgcgccggtcgggctggtcgcgtgtgccgcccttctcgccgccgccgaagacgccgatctgctcgtcgcggtcggtgctctcccaggtgacccggtgttcgaccccggggcggccgggctcggagaactccagctggatctggtccgacgtcagcctgcggtcgcgggcggcgaggacgaggaccgggtgcagggcccggcacgacgtgtcggtggtgttggtgaggtcgaggaaccaggtgccgtagccgccgccggaggcgtacctgtccggagcgtcctggatccgggtctcgatggggaagtccttggcgtccgggtcaccgcagacgggttgccggtcggctgccgaggaggcgggtgcggaggcggccggcagggcggcggcctgcgggccgcccaggagcgcggcgggcaccgtgatcccggcggccagcccgagggcggcgagcgcacgggcgtcacgccgccgtgcgcaggaagtggggggcatgaggggggcacccttcgctgctcgcggacgaccggggccggaggcctccggtgatggcctccgacgcaagcacgcgcgcgcggactcagagagtcgacatgccgacatgattcataggatcacccgactgctccccgctctgctt

SEQ ID NO: 4258 - DNA, 558 bp, Unknown
  Kingdom: Bacteria, Phylum: Actinobacteria, Class: Actinobacteria, Order: Streptomycetales, Family: Streptomycetaceae, Genus: Streptomyces
  misc_feature (193)..(211): n is a, c, g, or t
agggcggcgacgccaagggccgacacaccggccacggagatcttctggaccttgttcagacgacggacacggctgggtatgcgagtcgcagacatgtagggctacctcttcgaatgctcagggtgtcctcacggaggacgagaccggaggcggtgatgcgcacctccgtcggggacgagagcaattcttagcnnnnnnnnnnnnnnnnnnncgaattgaccctcgattgcgcctgctcaaatcgcccttatatgcccactaggtacgttcgtaagtgacgtaggccctatgcctgggctcacatcggcgacgcgacggtctcaccactcgttgctggagcaattcggagcgttacgttcctcatccggcaggacgagatggacgtccccgaacccctgccggaggtaccgctcccgcagcgccgcctcgtacccacggcgcagtggccctcgcgccccgccaccgcctccagcatcagcagatgcgcggcctgcggctcgtgcggcccggtcagcagccccccgcacgccctgccgccgcgtcaccaccagatccgtc

SEQ ID NO: 4259 - DNA, 847 bp, Unknown
  Kingdom: Bacteria, Phylum: Actinobacteria, Class: Actinobacteria, Order: Streptomycetales, Family: Streptomycetaceae, Genus: Streptomyces
ggtgccggagcgcgccggtccgcgggggtcctgcccgggtaccggcggccgtcgtggccctgctcgccaccggtctcgccgcttccccggcactcgccgcccccaccggcaccggggtgaaggcccgcgtcggcgccgactgggcgacgcagtcgatcaccttcaccgccggcgcgggacaggtgaacgacctccacgtggtgcccatggaccggggcgacggagtccggcgggtcggcttccgcgacgcggtcccgctcgtacccggcgaccactgcgcgtacctcacccccggggacgagacctatgtcgtctgcgaactgcccaccgacagctcccggccggaccggatcgacgtcttcctcggcgacggcgacgacgagatcgccaccagcgacccgggggtcgcgaccgtcagcggcggctccggcgacgacatgctgcacgcccacaccgcacacacggtgcggggcgacgcggggaacgacatggtcatgggccgcgtggtcctggacggcggcgacggcatggaccacctgatggccgtcgacggcgaccagcggctgtggggcggccggggcgacgacatgatcgaggcgtacgacggcgacgacctcgtgtacgcgggtccgggcgacgaccacgtcatgggcggggacggcgacgacatcctgctcggcggctccggcgacgacgtggtgcacggcgaggacggtgacgacgtgatcgtcggcggtgcgggcaaggacagcgtcgacggcggacccggccggaacatcgttctccgataggcgaagccggggtcaggggggcggggggccgggccccgcggccctcacccctgggg

SEQ ID NO: 4260 - DNA, 524 bp, Unknown
  Kingdom: Bacteria, Phylum: Actinobacteria, Class: Actinobacteria, Order: Streptomycetales, Family: Streptomycetaceae, Genus: Streptomyces
gcgtggacatcggcggcggcacgaaggaggaggcggtcaccaagctcgaagccgccctcgggaagcgggccaagacgccactccagctgtcggtggacggcaaggaggagaagctcgaccccgagaaggccggtctcaccctggacagccaggagaccgtgcgcggcgcggcgggcagcgactacaaccccgtctcggtgatcggttcgctgttcggcggggagcgtcccgccgacccggtgatcccggtcgacgaggagaagctcggcgtggcgctgaccgacctggccggtgcctccggctcggccagcgacggcacgatccgcttcgagccgaacaaggccgtggcggtgccgggcaagccgggcaggacgctggacgccggccagtccctgatctcggtccgggacgcctaccgcgcccaggtgcagaccgggcaggcccggctggtcgaactccccgtcaccaccagcgagcccaccatcaccaagaccgaactggaccgggcgatgaaggagttcgcc

SEQ ID NO: 4261 - DNA, 2891 bp, Unknown
  Kingdom: Bacteria, Phylum: Actinobacteria, Class: Actinobacteria, Order: Streptomycetales, Family: Streptomycetaceae, Genus: Streptomyces
gccgccgagatcaccgaggcggggcaccaggccacggcctaccccctggacgtcaccgaccgcgcggcggtcgacgagttcgccaccgcgttccgctccctcgccgtcctcgtcaacaacgcgggcggagcgctcggggccgaccccgtcgcgaccggcgaccccgccgactggcggcagatgtacgagaccaacgtgatcggcacgctcaacgtcacccaggccctgctgcccgccctcaccgcgagcggcgacggcaccatcgtgatcctctcctccaccgcggcgctgtccgcgtacgagggcggcggcggttacgtggcggccaagcacggcgaacacgtcctggccgagaccctgcggctggagatcgtcggcaccccggtccgcgtcatcgaggtggcccccggcatggtcaggaccgaggagttcgccaccacccgcttccgcggcgacatggagaaggccgccaaggtctacgcgggcgtcgacgccccgctgaccgccgaggacgtggccgacacgatcggctgggccgtcacccgccccagccacgtcaacatcgacctcctggtggtccgcccccgcgcccaggcctccaacacgaaggtccaccgcaccgtgtgacccccgggccactccttcggggaccgcgcgggtggcggccggggcgaccgtccggcccggcgtccccgtccgcgtagtgtgaggaaggaagcgtccccgaccgccctgccggccggaaagctcacgaaggagtggtgcccgatgaagctggtggtgcaggagttcctgacgctcgacggcgtctcccagggcccgggagccccggacgaggacaccagcgacgggttcacccggggcggctggttcgtgccgcacctggacgaggagttcgagcggcaggcgggtgagtggctcggcgaggcggacgccttcctgttcggccgccgcacctacgagaacttcgcccgggactggccgagcatgaccgaccaccccttctccggcatcctgaacggcctgccgaagtacgtggcgtcgaacaccctgaccgaggccgcgtgggacccgaccacgatcctgtccggagacgttcccgcccgggtggccgagctgaagcggcaacccggccgggacctccagatccacggcagcgcccgcctggcccagtcgctgctggccgcgggcctggtcgacgaactgcgcctggccatcgccccggtcgtggtgggtgagggccgccgcctgttcccggacggcggcgccccggccggcctgcggctcctcagccaccgcacgaccccggccggggtctccgtacacgtcttcacggcgacgggaccgccggacttcgcgacctacggggacggcgcgcagggcctcagcccttcacgcacaccacctgcttgagcttcgcgacgacctggaccagatcccgctgctgatcgatgacctgctcgatcggcttgtacgcgcccgggatctcgtccacgacaccggagtccttacggcactccacgccctgcgtctgctcctccaggtccttggtcgagaagcgcttcttcgccgcgttccggctcatccggcggcccgcgccgtgcgacgccgagttgaacgacttctcgttgccgaggcccttcacgatgtacgagccggtgcccatggaccccgggatgatcccgtagtcgccggaccccgcccggatcgcgcccttgcgggtgaccagcaggtccatgccctcgtaccgctcctccgccacgtagttgtggtggcaggagatgaccggatcgaaagtcacccgggccttcttgaactccttgcggaccacgtcctggaagagccccatcatgatcgcccggttgaacttcgcgtactcctgcgcccagaagaggtcgttgcggtacgcggccatctgcggggtgtccgcgatgaacaccgccaggtcgcggtcgatcagtccctggttgtgcggcagcttctgtgcctggccgatgtggaagtcggccagctccttgccgatgttccgcgaaccggagtgcagcatcaaccagacagaaccggtctcatcgagacagaactcgataaaatgattacccgatccgagcgttcccatctgcttcgtggcgcgctcctggcggaatttgaccgcatcggcgatccccccgaaccgcccccagaagtcgtcccatcccgccgtcgggaacccgtgcagcttccccgggtccaccgcgtcaccgtgcatcccccggccgaccggaatggcctgctcgatcttggagcgcagccgtgacaggtcaccgggaagatcgttcgcggtgagcgacgtcttgacggcggacatcccgcagccgatgtccaccccgaccgcggccgggcacaccgcaccctgcatcgcgatcaccgacccgaccgtcgcccccttgccgaagtggacgtccggcatgacggcgagacccttgatccacggcagcgtggagacgttgcgcagctgctgcatcgccacgtcctcgaccgacgcggggtccgcccacatccggatgggaaccttcgctcccggcacctctacgtacgacataactcctcgattcccccgaaaagactgaaagcgcaaaaccggtgccaagatcggcaaacctatcggccgaccggcattcacagcggcgcgtgcgatacacattgtgtccatcggccgccttcgagcggcaacccgttttccgtaccgaagggagcctgggacggtgcgagacatggcgtacgtacccggcgtcgcgcttctggcagcgctcgtcgtcggctgcagcgccggctccgacagcaacgcgaacggcgccgacagcaaggcgggcagccccacggtcacccccgcacccccgggcaagtacctgacc

SEQ ID NO: 4262 - DNA, 500 bp, Unknown
  Kingdom: Bacteria, Phylum: Actinobacteria, Class: Actinobacteria, Order: Streptomycetales, Family: Streptomycetaceae, Genus: Streptomyces
cggtcgtcccggcgggcaccacacgggggtgggtggtgccggtggtgagttggggcgtcatcaggttggccgcgtagcccgcctggtaggccgtctgcccgccggcccggtcgatcaggatgcccagccgctcgacgtcggggcgcagcaggaggcggttgacgatggggagggagagcgaggcgtaggagggagcggcctggaagaaggagccgttggcccgggccgggaaggcgatctggagggccgacaccgtcaggaccggcagcaccgcctcgtcgtacgcggccagtgcggacccggccgcctcgtcgcccgtggggccgatgaccgcgacgacctccgggtcgcgggcgaactcctcggcgacccgtgcggagcggacggggtccccctggtcgtcgaggaccttcacggcgagccggaagggctggtcgtcgagggagttgaagcggtcgacggcgagccgggcgccgcgttcctgggcacgtccggcggcg

SEQ ID NO: 4263 - DNA, 3535 bp, Unknown
  Kingdom: Bacteria, Phylum: Actinobacteria, Class: Actinobacteria, Order: Streptomycetales, Family: Streptomycetaceae, Genus: Streptomyces
tcctgggcggcggcagtgcgcgctactgcccgcactgccgccgcccaggacttggaccgtacgcagttgtgacacgttgattggctccccggggctccggagtcggcggaaagtacagcgccaaggatgccagcccgtacgcacgttccgggaccgccgtaacgttgctgccgcacccatggcgacaaccgaccacaccgcaccactctcccgggtgaatatcggggtgcggggttgtcgccgtccgccctgcggaagcacgtacgggcggaaggaatccccccgcccgtacccgtaccgcctccacgagcggctattcggcgcgggccgtggccagcagctcctccgcgtgggcgcgggccgtctcggagtcctcctggcccgccagcatccgcgacagttcccggacccggtcctcgccctccaggacggtgacaccgctgcgggtcaccgagccgtccacggtcttctcgaccagcagctgccggtcggcgaaggccgccacctgcggcaggtgggtcacgaccaccacctgcgcggaccgggcgagcttggcgagccgccggccgacctcgaccgccgccttgccgccgacgcccgcgtcgacctcgtcgaagagataggtcggtacggggtcggagcccgcgaagacgacctcgaccgcgagcatcacccgggacagctcaccgcccgacgcgcccttggcgatcggccggggctgggcgcccgggtgcggggcgagcagcagctcgacctcgtccgcgccggaggggccgtagacgacgctgcgcccgccgatgtcgatgccggacgcctcgtccgcggcctcggtctgccggatggcgaaggagacccgggcgtgcggcatggcgagcgaggccagctcgtccgtcaccgcctcggcgaaccgggcggccgcctccgtacgcgcatcggtcaacgcctgtccgagcacggagagttcggcccgcagctcgtcccgctcggcggtcagttcgccgatgcgctcgtcgtccccctccagttcggtgagccggccggcgccctcctgggcccaggcgagcacggccgtgatgtccgagccgtacttccgggtcagggtggtcagctcggcgcggcgctcctccacggcggccagccgcaacgggtcggcctccagctggtcggcgtacccggccagctcgccggagacgtcggcgatcaggatggagatctccccgatccggtcggccagcgcggccagcgccgggtcatgggcccggaccccgtccagggcctgcccggctgcggcgaccacggtggtggcgtcgacgctctccggatcctcggggttccccgccagcgcggtgtgcgcgagggaggcggcggaggcgagggcctcggcgtgtccgagccgctccgcctcggcggccagctcgacgtcctcgcccggcaacggctcgacggcggcgacctcgttcaggccgaaacgcagcagatccgcctcctgggcccgctccctggcccgggtggtcagctcgtccaaggtcgcggcgacggtccgcagccgccggtaggccgccgtgtacgcggcgtgcggacccgccacgccgtccccggcgtaccggtccagcgcaccccgctgccgcgcgggcttgagcaggccctgctggtcggtctggccgtgcacggcgacgagttcgtccgccagctcggtcaggacccccaccggcacggatctgccgccgaggtgggcccgtgagcgtccttccgccgagaccgtacggctgatgagcagcgcaccgtcgtcgagttccgccccggcctcctcggcccgcagcgccgccgcgtcgccctcggacaccgtgatccggccctcgacgaccgcggccttggccccgacccgtacgagggcggggtccgcgcgcccgccgagcagcagcccgaggctcgtgacgaccatggtcttgcccgcaccggtctcacccgtgaccgcggtgaaaccgggtgacagctccaccaccgcgtcgtcgatgactccgagcgaccgtatccgcatctcctccagcacggacatgaccttacgaggtcccgggccgggcgcgcgacggcccccgctcccggattcactctcccgagggtcacgggggccgaggaccgtctccggaaccgtcagtggggcgctccccgccagcccgagacgggcagcgcgaacttcgccaccagccggtcggtgaacgaggcctggtgcagccgtgccagccgtacgggcaccgcaccgcgccgcacctcgacccgcgcgccggcgggcagctccacggtccgccgcccgtcgcaccacagcaccccgtgcggggtgtgcggctggacctcgaccgcgagcacggacgtgggcgaggtcaccaacggcttcgcgaacagcgcgtgggcgctgatcgggaccatcagcagcgcctcgacctcaggccagacgacgggcccgcccgccgagaaggcgtacgcggtcgaaccggtcggggtcgcgcagacgatcccgtcgcagccgaacccggtgaccgggcggccgtcgatctccaggacgacttcgagcatccgctcgggcgacaccttctgcacggccgcctcgttgagcgcccagtcggtgtgcaccacatcgccgttgctgtgcacgaggacgtcgatcgtcatacgctcctcgacctcgtagtcgcgggtgacgacccgggagaccaccttgtcgaggtcgtcgcgctcggcctcggcgaggaagccgacgcgtccgaggttgacgccgagcatcggcaccccggaggcgcgggagaactccgcgcctcgcaacagggtgccgtcaccaccgaggacgatcagcagctcgcagccgtccacggctgccgggctggtgtcggtgaccgtctccacggtgtccggcagcggcagatcggccgcctccgtcgccaggacccgtacgccgagcccgttgcgcagcagaccctgcacgacgagctccgcgctgcggatcgcggccggacggccggtgtgcgccaaaaggaagactgttcgtgccgcattcgtcgtcaacgaggcccctccgccactgcacggtcgacatccgcgggatccagctcgggtgcgccggcccgcagccacagaaagtactcgacgttccccgacgggccgggcagcggactggccgtcacccctcgtacgccgaggcccagcccccaggcgcgccgcgccacttcccgtacggcttcggcgcgcagctccggactccgcaccactccgccgctgccgagccgctccttgcccacctcgaactgcggcttgaccatgaggaccaggtccgcgtcgggcccggcgcaccgggcgagggcgggcagtacgaggcccagcgggatgaaggacagatcccccaccaccaggtcgaccgcctccccgtcgatggactccaaggtcaactcccgcacgttggtacggtccttgacgacgacccgttcatcggactgcagcgaccaggcgagctgcccgtaaccgacgtcgacggcgacgacctgcc

SEQ ID NO: 4264 - DNA, 2467 bp, Unknown
  Kingdom: Bacteria, Phylum: Actinobacteria, Class: Actinobacteria, Order: Streptomycetales, Family: Streptomycetaceae, Genus: Streptomyces
cgtagacctggtcgaggaagaccaggaggtgggcgctgctgccggtcagccgggtcaccccggcccggacgacctcggtggtgagcgtcagcttctggtcggcggactgccgctcgacctggccgaacagcgccgcgtactgctggagcgccttgcccgccaggacctccttcgccgccgccctggtggcggcggtggcaccgggaccgtaggagaagatcttcccgagcgcgctgctgacgtcgccggtgacacgggtggtcgcctccgcgtcggtgagcgcgaggttcgccgtggccggggtgtcccgcaggtggcgtccctcggcgtacagggcaccgcccgtggcgatcagggcgaccgccagaagtgcgccgaggacgcgcggccaccggcggcgggacgcgtcgtccacgacatccgtcgcatccgccgcatccatcgtttccggcttttccggcgcatccgccgcgtccatcgtctccggcgtttccggcgcgaccgtctccgccgtggcgtccgtcgggtccgatgcttccgtcacgtccgtcacgtccgtcgcgtccgtagccgtgctgttcaccgtggtcgctcctccccgcggtctcatcggccgccgcccgttccgatcgccgtgagcgccttgaccttccagccgtcggccgtacgggcgagggtcgccgcgaaccgcttgcgctgggtgccgggcgcgccggtgcgcggagtgaccgcgacgtccacggtggcgatcagctccgccgtgcccgtgcgctcgtccagagcggtcagcgccgccgaggtgacctttccccgggccgtgtcgcccgcggtcgtcagggacttcgcgtcggcttcacgggtccgctccagctggtcgtgcagcggccccgtggaggagtccagccaggcgcgcagcccgtcgtcgacccgcttcgcgttctcgccgtccaggctgttcagcgtcgcgaggtgccgttctccctcggccagggccgtgtcgcgggccttcgcgtaggacagggagcggtcgccgcgcgcctgcccgtacgaccaggcccccaggccgcagaccagggcggcgacgagcagcacggcccagccggcccggcgtcgggtgcggggggtcatgagccgcctcccaggcccagcagcccggccatgccctcggtcggcggctgtgcggtcgcggacccggcgtcccctgttcctggcagcttcatcgagccgggaacggccggcttcggcaccgggccgcccttgggggcgttggcgctgccccggacgttgatgccggtaccgggcgaggaggtgcagcgggcggcggtgttcacggcgggcccgtccgaggtgttgaggccgttgcggtagaccgtgccgccgtaccccgcggtgcacggcagcggttcgaagaaggtgacggacatcccgaaccgggcgccgtcgtcgtcgaccgcgctcgctccggcggcgacgacggcgggcagcttcacgaggagttcctccaggccgcgttggcgggtgacggcgacctccgaggtggtgaggaggttggcgacgacgacgccgaaggcgggatccaggtcgcgcagcagaccgctgatctggacggctgcgtccggggtggtcgcgatgaggcggcgcagatcaccgtcggagcccttgagttcggctgccagttccctggcccccgaggcgaagcccttgagtgcctgtccctgttcggcctgggtgcgcaggacgcgctcgccgtcggccatcagccgggtggtgaccggcagggccttgtcggcggcctcgacgaagtcgccactggtgtccagcaggacctggaggtcgtcgccgcgtccctcgaaggcggccccgaactcctcgacgacggtccgcaggctttccaggtccacggagctcgccaggtcgtcgacgctggtgaggacgtcggtggggggtgcgggggtggtggtgtcggcctcgtcgatgaccgagccgttgcccaggaagggcccgtccttgcgggtgggccgcagatcgacgtactgctcgccgaccgccgagaggttggcgacgacggcggtgaggctgtccgggatcggtggcgcgtcgttctcgatccgcagctcggcctcgacgccgtcctcggtcagctcgatggggccgacgcggcccacggagacgccccggtaggtgacgttggagtgggtgtacaggccgcccgtctgcgggagttgcaccgtgacggtgtagtagctgcgcagtccgacgtagtggccgagatcggcgtaccgcacacccaggtaaccgaggaccagagcggcgatgacgaggaaggcgaggttcttcagccggatggagagggtgatcacggtgtcgcccccttcgcggagttcgaggcccccgacgcgtcgggcttcgacgcgtcgggcgcgtccgtcttcggtgcgccggtcttcggcgttcccgacacgacggg

SEQ ID NO: 4265 - DNA, 4303 bp, Unknown
  Kingdom: Bacteria, Phylum: Actinobacteria, Class: Actinobacteria, Order: Streptomycetales, Family: Streptomycetaceae, Genus: Streptomyces
accggcggccgtgaccacggccgccgacggcgccgcaccggacgacggtcacgtccccgtcccccggcagccgggagagccgaaacggccgacgctccgctccgacctgcgggcctcgtggcccgacggcctggtcgcgctcctcatcaccgcggcgatcttcgtcctgctctacctacgcatccgcaacaaaacctcgtccacggtcaccgtgatgccgttcatggccgacgcgggcggcttctggatgtacttcctcagccaggcgttcggctggtccgctctgctctgggcctggggaaccgtcatcctcgggctgatgctgtccggcccccgtccccgccgcctgccgctgtcgggcccccggctggaacgcctgcaccgcaccacgagcctcaacaccatcgccctgatcgtggcccacgccctgctgttcggggccgagttggtccggcacgacaccgcgtcctggaactccgcggtcgccaccgccttcatggaggccctcgtccccggcggctacgactcgggaaccggccggatcgccatgcccatcggccaggcggccctgtatctcgcgatccccctcggcctgctcttctacgtacgccaccgcatcggccccaagacctggcgggtactgcaccgctgcgtgatcgtcgtctacgtcctcagcgtctggcacaccctcttgtacgggaccaacgtctggtacgacggctggttccgtacgagtgtctggctgctccagctcccgatcgccgcgctgctgctcctgcgtctgatgcggcccgcccgccgctccgagaagctgcccgcccggcccggagcgaccaccggggcccgcaccgggtgggctcttcgggtgggcggccggctcgccgcggtggcggtcctggcggctctgatcgccgtcgtggccagtggcagcgacggcggacgcagcacgcccccggaggacacctcctccacccacaaccacgactgagaggccgtccgccaccgcacgtgagcgccatccgccaccgcgggcgggcaccgtccgccaccgcgggcgagagccgtccgcccggcgacgtacgctcggaggcatgaccaccaacgatcttcccgtgatcgccgccgtcgacggctccacgcacagccggcaggcgctcgactgggccacccacgaagccgtgcggcggcggctgcccctgctgatcgtccacgtccgcccgctcacccggcaggtcgacgaggagaccggacggcgcgaggcggaggccctcctggccgagtccgtacgccggagcgcggccatcgctccggagctgcggccctcgacgctggccccgctggacttcccgtcggcggccctggtctcgctcggccgggacgcgtcgatgatcgtggtcggatcacgcgggctcggcggcttccgctcgctgatggtcggttccaacagcctcgccaccgcgtcgatggcgagctgtcccgtcgtcgtcgtgcacgaggaccgcccggagggggacgacgaccgggccggggacgcgggtgccttcaccgacatcgttgcgggggtggccgccgacgagagcagcgaggctgtcctggagttcgccttcgccaccgcggcttcccggccgggtgcccggctgcggatcgtgcacggctggacgatgttctcctcgatgctcgcgggcggccccgtcctggaccggcaggaggcggcgggctcggccgcgcggacgctggccgagctgacttcggggtggcacgagaagtacccgcaggtggagatcgtccgggagccggtcaacggttcggcctcgcgcaccctggtgaccgcgtcggcgacggcggccctgacggtgatcggccgccgcaagggcggtgagtcgctcgggctcgggctgtccccggtggctcagacggcggtcacgcacgcgctgggcccggtcgccgtcgtgccctgctgagccacatctccgtttcccggcgagccgctccccccgctccccggtgagccgcttctccctgccctggtgagccgcttgcccagcgggttctcccgtgcccccgagtcgccccccgggcgtcccgtcggcgcgggccccttggcctggcgggcggcttgaccgagacttgaccgatgacacagcgtgtggcgctcgcgaccgtgatggaccggctggccatcgatgcggtgatcaccgggtatgcggtggccgtcgacgacggggcctggtcggactacggcgccctgttcaccccggacggccgcgcggactaccgggacgcgggaggcgtggagggcccggccgaggagatcgcccggtggctgggggagacgatgcgcctcttcccggtgcgccagcatctgatcgtcaaccgccggatcgacctggaggacctgggcggctatacgggcgaccgggccgaggtgctggccgactacctcaatccgatgtgtctggcccggaagacggcgagcggctcgggcgcggacgcggagggccgggcggattccgggcaggcaggcggccccacccccgacttcgtcaccggcggccgctacgccttcgagctgcaccgcgccgaaccgggctggctgatccacacggtgaccgtccacgagaagtggcgccggacaccgggcgcgtagcgcccgtcacctctggcgtcgccgccgcccgaaggcgccgggaccggccgccgtgccccgctcggcccgtgtcctgtgtccggcggggatcacctcctccacactgggtatccaggggttgacgcggtgacggcgaccgcccgcccgcgcacgaccgaggagggcacggcatgcgaatccggggcgggcgtctcccgaccggccggaacccggccggtgcggcccatggaggcactgcggcagaaggcgcttcgggcgagggcacggccgctgaaggcacgtccgctgaaagcgcatccggtgaaggcacggccggcgaaggcggctgtgatgacggcgcctccggtgacgggccggcggccggcggccggggttcggccgcctcggggacgctctcgtccccctggctccggggcgcggcggctctgctcgccggggcgctgcccgcgctcgcctttcccgcacccggactctggtggttcgcctacgtggcgctggtcccctggctgttgctcatccgcacggcgcactcgccccgcagggccgcgctggacggctggatcggcggcatcgggttcatcatcgcggtgcaccactggctgatgccgagcctccacgtcttcatcgtgctgctggccgccctgctggggctgctctgggctccctgggggctgctggtgtcccggctgctcggcgggtctccttccgcgtcgcgtgccgtcgccgccgtggtcgtcgtgccctccgggtggctcctgatcgagctggtccgctcctgggaagggctcggcggaccctggggactcctcggcgcgagtcagtgggaggccgcccccgccctgcgggtcgcctcggtgggcggggtgtggctggtgagtctgctggtgctcgcggtgaacacgggtgcggcgttgctggtcgccgaccgcgcggcccgtacgaccgccggcgtcctgctggtggtgtgcgccctgtccgtcgcggcgatgtgggcctgggcaccccggcccacgggcaccggcacggtcaggatcgccgtcgtgcagccgggcctcgtggagggaccgggaagtgtcgcgcgccgcttcgaccggggcgaggaactgacccgctcgctggagggccggggcgtggacctggtggtgtggggcgagagcagcatcggtgcgggtgcgtgggagcgtccggagaccgcacggcggctggcggagctgtcccgtcgggtcggcgccgatctgctggtcaatgtggatgcccggcagacggacggctcggggcggtccgggatcttcaagtcggcggtgctggtgggccccgacgggccgaccggggaccgctacgacaagatgcgtctggtcccgttcggcgagtacgtaccggcccgctccctgctggggtgggcgacgtccgtgggcaaggcggcgggcgaggaccggctgcggggcgaccgccaggtggtgatgaccctgccggacggggagcgggggccgcggatcggtccgctggtctgcttcgagtcggcgttccccgacatgagccgcaggctggtgcgcgacggtgcgcaggtgatcgtcgcccagtccgccacctcgacgttccaggacagctgggccccggcccagcacgcctcgctgggggcgctgcgggccgccgaga

SEQ ID NO: 4266 - DNA, 622 bp, Unknown
  Kingdom: Bacteria, Phylum: Actinobacteria, Class: Actinobacteria, Order: Streptomycetales, Family: Streptomycetaceae, Genus: Streptomyces
gtcgtgcgccgggctgtcggaggcctggcggtccggggcgcgctcgggcgcgtgcgccgggtcggtcagcctggcttccgtgtgcgccggaggcgcggcaaaggcccggacgtccacggattccatacggtccgtttcccggtccgggtcgacgtcgggcgtcgcctcctcggcggtgcgctcccgcaactccttggcgtaccggcgctccatcgccgcccgtccggacagcagccggatggcggtgctgaagcgttccgtcggacgggcttcattgagctcgtcctgcctgcggagccacatcggcaccaagtaggcggcccaggccccgacgatgactgcgtagatgaggccgctgctgctcacgctcacaccgtagaggggtttgcgcggaaggatccgccaattggcccggtgtgtcgcacgatccggctgatatcacggactttttttgtgattgttcggatcaacagccgccgatagcccgacccaatgcggtcacccggcgatcaaattcgaacacctatttcatttcaccggtcggcccggggtcgcgcggcggcccggggcgcgaccggcgccagcgccggagcatcccctcgggcacttcctcggcggtgag

SEQ ID NO: 4267 - DNA, 649 bp, Unknown
  Kingdom: Bacteria, Phylum: Actinobacteria, Class: Actinobacteria, Order: Streptomycetales, Family: Streptomycetaceae, Genus: Streptomyces
acccgcagcagcctccgccgccgcagcagggcggctggggtcagcccggcatacccggcggctggccgccccagggtgcgcagccgccgcggaggaagcggaccgggctcatcgtcgggatcgcggtcggcgcggtggtggtggcgggcgcgatcgtcttcggcgtcacccagctcgccgacaagggcaccgacctggcgtacccgaaggcggagtacgagctcctcgtgcagcagaagctcctggacggcgagttcagcctgggccaggacctgtcggagaccgagggcaaggagatcgaggacactcccgaccccagcgtccgcgacggcgaggcggtcgtcgcgcactacgcgtcggccaagggcggcgccctggtgctctcggggatgtacgggcggctggccagccccgacttcatgcgcggcaagatcatggagggggcggcggaggccgacggcgcgaagctcgtcgtacccgccaagaagttcacgcccgaggggtacgacatcacaatcgagtgccaggtcgtgcagtcgaacgagggcggcggcgtcgcgaacatccccatgtgcgcctggggcgacgacaacaccgccgcgatgatcgcggtgatccgcccggagagcgtgctcaaggacgccaggtc

SEQ ID NO: 4268 - DNA, 667 bp, Unknown
  Kingdom: Bacteria, Phylum: Actinobacteria, Class: Actinobacteria, Order: Streptomycetales, Family: Streptomycetaceae, Genus: Streptomyces
ggcgaactcctcctcgaccggctcgccgccgcggtcgaggaggagttcgccgagctgtacacggtcatcaccggcacggaccgctcaccggtgtcctgacaggcagccgcccaccggctgcggcagtctggagccatgcccgaactgcctgaagtcgaagccctgcgggtcttcctcgacgatcacctggtcggcaaggagatcgcccgcgtcctcccgctggcgatcagcgtcctgaagacgtacgacccgccgctgaccgccctggagggcgcggccgtcacgtcggtcgcccgccacggcaagttcctcgacatcgaggcgggtgggctccacctgtgcacccacctcgcccgggccggctggctccgctggaaggactccttcccggccgcccggccccgtcccggcaagggtcccctcgccctccgcctgacgactgtcgaaggcgacggcttcgacctcaccgagatgggcaccacgaagcgcctctcggtccacctcgtccacgacccccaggacgtccccgggatcgcccgcctcggcccggaccccctcgcggacgccttcgaccgcgacgccttcgccgcgctgctcgccggggagcgccgccagatcaagggcgcactgcgcgaccagtcgctcatcgcgggcatcggcaacgcct

SEQ ID NO: 4269 - DNA, 1549 bp, Unknown
  Kingdom: Bacteria, Phylum: Actinobacteria, Class: Actinobacteria, Order: Streptomycetales, Family: Streptomycetaceae, Genus: Streptomyces
cgccgtacccgtcacggcggacctggacggggtggaggacgggcggcggtggcgccgctgtgcttgctgatgttggtgagcgcctcggcgaccacgaagtaggcggcggcctcgatcgcggcgggcagccgccgcccgtcctccaccccgtccaggtccgccgtgacgggtacggcgacatcggcggccaacgcccgtaccgcaccggccagtccacggtcggtgaggaccggcgggtggatgccgcgcaccacgtgccgcagctcggcgagcgcggcttcggccccgtcctgcgcctcgtcgaggcgggcccgcgcggcggccggatcgcggtcgaggagctgtttggcgagaccgatccgcatcgacagggcgacgatccgggcctgggcgccgtcgtgcaggtcccgctcgatgcgtcgcagttcggccccgtgcgcggcgaccgcgccggcccggctctcggtgaggtgggcgatccgttcggtgagttcggcggcgggctgcggggcgagcagcgccatggtccagcccgccgagaggtcggccagcaccgggtgccagcgcagtgcccagcccggccgttccggcggctcgatgccgtattcgtcggcccgccgccggtccaccggacccacgacggacagtgcgatgccgtccaccagcagggcgacgggccacaggaccatcgtgaggtagccgaggcccatgccgaagagcgtctggaggggcagccagagcgcgagccgccaggtggtccggtcggtgagcgtccgccggacccgttcgggcagctcgccgccggccaggggcggatacgaggcgggccggtggccgggcccgagccgggccgccgctctgcggctctccgccgaggcggcccggcgcagcagcgtggcggcctccggcagcgcgggcagcccgatgatcgcgacggcgaacaggaggaccgccaccaccaggaaggtgccgaggtaggtcagcatcgcgaccccgatgccgaggaggaggtagcgcgaggcgtcccaggaacgccggacggcgaccgtgaggggaccgggtggggagctgctcatggcagcccacggtacgggggcggtccccccgccggaggggggtggtcccccgggcgggggtggagctggctgcacccccggtccggtagtgcgcaccctcgcccggacgcttcccggcacatagcgttctagcaggtcaaacggtacggggacggtggaggcgaacagtgagtacgacgatggtggagcaggcgaccgcgctcggtctggagggggtgagccggagctacgggcggtgcgggagcagccggaggacgacagcgctcgacgcggtcagctgcgcggtcccggccgggagtttcaccgcggtggtcggcccgtcgggttcgggcaagagcaccttcctccaggtcgcggccggcctggaccggccgacctcggggacggtcaggatcgccggcacggatctcgggtcgctctcggaggcggcgctgacccggctgcgccgggaccggatcgggttcgtcttccag

SEQ ID NO: 4270 - DNA, 3205 bp, Unknown
  Kingdom: Bacteria, Phylum: Actinobacteria, Class: Actinobacteria, Order: Streptomycetales, Family: Streptomycetaceae, Genus: Streptomyces
gcacccgccatgccccacagaccgagcgcccgggaccgggcgggcccggccgggaaggcgagggtgatcagggcgaacgccaccggagcgagggccgccgcgccgacgccctggacggcgcgcgccgccaccagcgacccgggcgaccaggcgagcccgccggccaggctggcgagaccgaagagcaccaggcccgccgtcaggacccggcgcggaccggccagatcggcgagccgcccgccgagcatgaggagcccgccgaaggcgagggcgtacgcgttgacgacccacagcagtccctccccgccgaatccgaggtcgccgcggatgtcgggcagcgcgacgttcaccacggacatgtccagcgacaccaggaactgcaccgtgagcgccaccaccagcagccaccgcgcgtgccgctcccccgcgcccgccgcacccgcctccccgccctcggcgcctcttcccgtcccgctcttctccgcgccgcccatgacgtccccttcccttcgcgcttccctcgtccggaaattaccatacacgtatagaaaataagcgccggagcaccgggagggtcccgcggcggaccggagcacggccccggaaggagagaatgcccaggtgtcaggcaccgagaagaccgagaagacgaagaagacgaaaaatccggcgtcgggcggcaaaccgggcaccgccggacgacccgtggggcggccccggcggctggacccggacgtgatggtcgccaccgcgcgccgcatcgtcgaggaggagggtgtggccgccctgtccatgcgacgggtggccaaggagctgggcagcacgcccatggcgctctaccactacgtccaggacaaggacgagctgctgatgctcaccctgtccggcacggcggcggcgttcccgcgcccggagctgcccgaggacccgcgcgagcggctggtggcggtggccgcgcacatgcacgacatcatcggccggatcccctgggtgctggacatcctggcgctgggcgaagtgaccgaccgcaacgcgctgtggatggtggaggagatcatcgactgcgcgctcgcctgcggcctctccccggtccgctcggtgcgggcgtaccaagcgatctggagttacgtctacggggacctggtcttccgcagggcggcggaccgccgggcggagaacccctcgcgccgggagttcttcccggagatgatcaccgagcgggacgcggcggagctgccccggctcaccgaggtcagggaccgctggcgggagtacgccgccgactacgagaccgtcgaggagctcgacgcgatcgtggacggcctgatcaggcgcgggacgcgggacacgaagacccgaccggaccggaacgcgacggcctgaccgggccggaaggcctcacggaccggagcacgaggacccggccgggccggtccgcgggagcccgccggctcccgtccgcccggtcgtcgtcgctcagtccaccgcctcgaagcgccaccggtgcaccggacgggtgatcagggcggcgtcgggctcgggtagttcggggaggtcgtcgccgtacgaggcgccttgccaccacgtcatcaccagcacccggtcctgcggggcgcgcagcagttcgccgcggtgcggttcgcgggccagctcggcggcccgcgcccgcgcccactccaggagttcgccgccgcgtccctcgacggcgcgggcctcccacatcaggacgatggtcccggcgctcatgagtacaggttgtccttgctgatctcgtgcacgtggtcgtgcgtgtgctcatggtgggctcccggcacgtgcggctcggtcaccggcagcgaggagtccgcggagagctccaggtcggagggacggcggttgcgggcgaccatctccgcgccgagcgccgcgaccatcgcgccgttgtcggtgcagagcccggggcgcggcacccgcagccggacgccggcccgctcgcagcgctcctgggccagggcgcgcagccgggagttggccgcgacgccgccgccgatcatcagatggtcgacgccctcgtccttgcaggcccggaccgccttgcgggtgagcacgtccaccacggcctcctggaaggacgccgccacgtcccgcaccggcacctcctcgcctgccgcgcgcttcgcctcgatccagcgggccacggaggtcttgagcccggagaaggagaagtcgtacggagcgtcgcgcgggccggtcaggccgcgcgggaacgcgatcgacgccgggtcgccctccttcgcgagccggtcgatgaccgggccgccggggaagccgaggttcagcacgcgggcgatcttgtcgaacgcctcacccgccgcgtcgtcgatcgtcgcgccgagcgggcggacgtcgctcgtgatgtcgggggccagcaggagcgaggagtggccgccgctgaccagcagggccatcgtcggctcggggagcgggccgtgctccagctggtcgacgcagatgtgcgaggcgaggtggttgacgccgtagagcggcttgccgagcgcgtacgcgtacgccttcgcggccgagacgccgacgagcagggctccggcgagcccggggcccgaggtgacggcgatcccgtcgaggtcgcgggcgctgacgcccgcctccttcagtgcgcgctcgatggtggggaccatcgcctccaggtgggcgcgggaggcgatctcggggacgacgccgccgaagcgggcgtgggtgtcgacgctggaggcgacggcgtccgcgagcagggtcgtcccgcgcacgatgcccacgccggtctcgtcgcaggaggtctcgatgccgagtacgaggggttcgtcggcagccatcattcagtcccggtctctggtgcgtgctcgtgcactgcttgctcttgcatggtgaggcgcatgaccagggcgtcgatgttccccggctggtagtagccgcgccggaagccgatcggctcgaagccgaagcgctcgtacagcctctgcgcccgtgtgttgtcgacccggacctccaggaggaccgtggcgcactcgaagtcggtggcggccttcagcagatcggtgaggagttcggagccgaggccggttccccacgcctcgcggctgaccgcgatcgtctggacgtcggccagatcgccgagggcggcgagcccggcgtagccgacgatccgcccggtcgccgggtcctcggcgac

SEQ ID NO: 4271 - DNA, 2912 bp, Unknown
  Kingdom: Bacteria, Phylum: Actinobacteria, Class: Actinobacteria, Order: Streptomycetales, Family: Streptomycetaceae, Genus: Streptomyces
tgctgggccgggtgctgtcgggtgcggtgaacctggtcgacccggacgcggtggtgctcggcgggatctaccggggactgatgccgtggctggcgccgcccgccgacgcggaactgaccggccgggtggtgtcggggctctggtccccgggcagcggccggctccgggcgtcgtcggtggcgggcgacgcggcgcggggagcggcggcgctcgtggtgcaggacgtgctggacgatccggtggcgtacgcggagccgtccggcggctgagccggagccggacggccccggcccagccggcgggtcggcccactgggtcagcccggtgggtcagcgcactgggtcagtccggtgggtcggcccggcgggtcagcgcacggcgagcaggtggtccatggcgagctggtccagtgcctcgaaggccatcccgcgcgccgcggcggcgtccacgtcgaactcctcgtacgcgctgcggtcggcgagcagggccgccagtccctcgcccgcggtggggcgcgccagttcgtccaggcgggacacgcgcagggccgcccgcacctcggggtcggcgcggaaggcggcggcgcgctccttgaggatgaggtagttgcgcatgcagcccgcggcggaggcccagacaccgtcgtagtcctcggtgcgcgggggcttgaagtcgaagtggcgggggccctcgtagccgctctccagcaggtcgacgagccagaacgcctggcgcagatcgcccgcgccgaagcgcaggtcctggtcgtacttgatgccggactggccgttgaggtcgatgtggaagagcttgtccgcccacatcgcctgggcgatgccgtgcgggaagttgagcccggccatctgctcgtgtccggtctccgggttgacgccgaccagctcggggcgctccaggcgctcgatgaaggccagggcatggccgatggtgggcagcaggatgtcgccgcgcggctcgttcggcttgggctcgatggcgaagcggaggtcgtagccctgctcgacgacgtactcgcccagcagatcgaaggcctccttcatccggtggagggcgaggcggacgtccttcgccccgccggactcggccccctcgcggccaccccatgccacgaaggtgctcgcgcccagctcgacggcgaggtcgatgttgcgcagggtcttgcggagtgcgtagcggcgtacgccacggtcgttggcggtgaacccgccgtccttgaagacgggatgggtgaagaggttcgtcgtcaccatgggcacgacgagtccgctgctgtcgaccgcctgccggaagcgcttgacgatcctttcgcgctcggtctccggcgccccgaaggggatcaggtcgtcgtcgtggaaggtcaccccccaggcgcccagttccgcgagccgctgcaccgactcgacggggtcgatggccgcgcgggtcgcgtcgccgaaggggtcccggccctgccagcccacggtccacaggccgaagctgaatttgtcctcgggggtgggggtgaagcgttccgtcatcgtcgtccgaccgccttcgcctgccgtcgggacgcccggccgccagcccggcacccctatttgttcagtgtcatgactaatcaagcacaccgcacccccggcacggaacccccctaccgcacggtgtaccccccgaccccctgtgcagagggtcgcgcatcccgtaatttgttcgtgccgcagccgaataccggcacccgtgaccagcacccgcagcgcgaaagaggcccccatgccgtcacccgccgtcgtcatcggcgtggacagctcgacccagtccaccaaagccgccttcatcgacgccgtgaccggcgaacagctcgccgtcggacgcgccccgcacgtggtcaccggcgagaccggggcccgggagagcgatccggagatctggtggcgggccctgtgcgcggcggttgccgccggactgaaggagtccggcctccccgcccgcgcggtcaccggcatcgcggtcgccggacagcagcacggacttgtcgtgctggacggggcgggccggccgctgcgtcccgcgctgctgtggaacgacacccgctccgcgccgcaggccgccgctctcaccgacgcgctcggcgggcccggggcctggacggagcggaccgggtccgtgccggtcgcctcgatcaccgcgtccaagtggcagtggctgcgcgagaacgactccacgatcgccgcgaacgcggcggcggtccggctcccccacgacttcctgaccgaacgcctcgcgggcgtcgccgccaccgaccccggggacgcctcgggcagcggctggtactccaccgcgaccggtgcctacgaccccggcctgctggagctgctcggcctggacgcgaccctgctcccggaggtcgcgcccaccggagcggcccggatcggctcgctcaccggagcggcggccaaggcgctcgggctgcccgcgggcatcgcggtggcggccggcaccggcgacaacatgagcgcggcggtgggcctcgggctgggcggcgaggggctgctggaccacccggccctgagcctcggcacctcgggcacggtgttcgccgcctcccgcacccggcccacgtccaccgcgctgaacgggttcgccgccgccgacggcacgtacctcccgctggcctgcaccctcaactgcacgctcgccgtggaccaggtggccgccctgctcggcctggaccgcgaggacgccgcgcccggcggcgacgccgtcctgcttccctacctcgacggcgaacggacccccgacctgccgaacgcctccgggctgctgaccggcttgcgtcacgacaccacccggcagcaactgctgggcgccgcctacgagggcgcggccgtcaccgtgctgcgcgccctggacggtct

SEQ ID NO: 4272 - DNA, 1136 bp, Unknown
  Kingdom: Bacteria, Phylum: Actinobacteria, Class: Actinobacteria, Order: Streptomycetales, Family: Streptomycetaceae, Genus: Streptomyces
gttccgccgggcctcggcggcgtagtcgtcggccttggccgcggagtcgagtgccttggccgcccattccttggcctcggcggcggcgctacgcgcttcggcgccagccttcgatgccagggcggcgttctcctgtgccttctcggcgatcttcgcggcggccgcgatggcgccgcggatcgcggcgacatgggtggcggtgtcgtggtcgagctgggccgtccggtactgcaccaggttgacgaagttgcggcgcatccaggtgggaccctccatggccacctcggcgtacgccctggtgaaggcacccccggtgttcatcagcgtgagcgtgcggaccgcgtcgtcctcgcggacggcctcggggtagtcgtggtcgaagaatctcgaaaacgcttccgtggtgttgaggtcgagtgccttgttcgccgcggcggtgacggccctgccggggttcgagcccaggatgcggatgatcgccacccggttgtcctcgtcggacgcccgcttcatgccgccggtgaggaagtcgccgacggccttggagtcggggctctccagggcgccctgggccgctgcggcgatcttgggggcggcgaccgtggccacgtggagcgtggtctcccggtcgtcctgcccctgggccagggcccggtcgatatcgatccaggcgtacacgtcgtcatcgctgccggagagggcgaactgggccgcctgccgggtccaggctcccctggagtcgagcagggcgacggccgccttgcgtccctggaccgccgcggcaaccatgtcgttcgccgccagagcctgctcggccttggcgatcaggtccttcgtcgcctggtcggtctgctgggcctgggacgccctgttctggtaggcggccacctccttcgtctcgatctcggcgagcagccggacctcctcgatggcctgcagcttgtcctgctcgagggtctccgcctcggccttccgggcgttctgctcgaccaggagggcgtccgagacggccttggtggccgtgttcgcggccagcaccgccgccgccgcgctggcggtcgacctgttggcgtagtcgacggccttgcccgcgtacttcacggcctcctcggcggcggccgccgccgaggaggccg

SEQ ID NO: 4273 - DNA, 3657 bp, Unknown
  Kingdom: Bacteria, Phylum: Actinobacteria, Class: Actinobacteria, Order: Streptomycetales, Family: Streptomycetaceae, Genus: Streptomyces
  misc_feature (295)..(319): n is a, c, g, or t
ccggggccgcggacgcgctggccggggcgctggcccggctgctggaccgcccgcagctgcgcgcccggctcggcgcggccggccgcgagcgggtgctggccaacttcacctgggccagggcggccgccggaacggccgaactgtaccgtcaggcgatcatcacccgcggagtccgcaggtgaccgcacgccccccggcgaccgcggacccgatcgtcgcaacccgtacctccgacctcgaaggcaggccctcgtgctgaccgtcgacttcacccgcttcccgctcgccgccggcnnnnnnnnnnnnnnnnnnnnnnnnncgaggagatccgcgaggtcgccaagtggttcgccgccatgaaggaggccggggaggcccccgagggcgccaccgccaccgcgatggagggcgacgccctcaacctgcccttccccgacgactccttcgacgtcgtgatcatctccgaggtcatggagcacatcccggacgacaagggagtcctcgccgagatggtccgggtgctcaggccgggcggccggatagccatcaccgtcccgcgctacggccccgagaaggtctgctggaccctctccgacgcctaccacgaggtcgagggcggtcacatccgcatctacaaggccgaccagctcctcgcccggatccgcgaggccggactcaagccgtacggcacccaccacgcccacgccctgcactcgccgtactggtggctcaagtgcgccttcggcgtggacaacgaccaggcgctgccggtgcgggcgtaccacaagctgctggtctgggacatcatgaagaagccgctcgccacccgggtggccgagcagctcctcaacccggtcgtcggcaagagcttcgtcgcctacgccaccaagccgcaccttccgaaggcagaggcgtgagcacccccgaacggaccgaacacctcgttctgccgggcgtcctgacggcggctcaggccaccgagacggtcgccgcgctcgccgccgtacagcgggaggacggggcgctgccctggttccggggccaccacctcgacccgtgggaccacaccgaggccgcgatggccctggacgcggccggcgagcacgaggcggcggcccgcgcctacgactggctcgcccgcaaccagaacgccgacggctcctggtacgccgcctaccacgacggtgatccgcagcagccgaccgaccggggtctggagagcaacttctgcgcgtacgtggccgtcggcgtctggcaccactacctggccaccggcgacgacgcgttcgtcgaccggatgtggcccacggtcttcgcggccgtcgaattcgtcctcgggctccagcagcccggcggacagatcggctggaagcgggagcccgacggaacgcccgtgaccgacgcgctgctgaccggctcctcctcgatccaccaggcgctgcgctgcgcgctggccatcgccgagcgccgcgaggagccgcagcccgactgggagttggcgaccggggcgctggcccacgcgatccgcagccaccccgagcgcttcctcgacaagaaccgctactcgatggactggtactacccggtcctcggcggcgcggtcaccggggccgaggccaccgcccgcatccaggagggctgggaccgcttcgtcgtccccggcctcggggtgcgctgtgtgctgcccaacccctgggtgaccggcggcgagagctgcgaactcgccctggccctctgggtgacgggggagtcggaccgggcgctggagatcctccagtccgtccagcacctgcgcaccgaaggcgggctgtactggacgggatacgtcttcgagggcaaccgggccttctggcccgaggagctcaccacctggacggcgggctcgctgctgctcgcggtggccgcgctcggaggggacgaggcgaccaccgccgtcttcgggggcgagcggctgccggtcggcctggagccggactgctgccgctgaacacgtcctggggcgggccctgttcagccgcggcggagccggcccgccaccgcgtgcccgatgaagaggtagaccacggccgcgaggccgtatccggtgacgacgttcgcccacgccttgtcgaacgtgaacaggtcgtacgaccagcccgccagccagcgggccgagtcgtgcacccactgcacgaagtcgttgccgcggttggcgtccagcaggtacatcagaatccagaggatgatgatgaaggccagaatgtcggccacgacggctatgacacgagccgctgaactgcttcctgaacgggttctgggagacatggaactctggttgcctctttacgcagggtgaaacccggacggcccgtaccgcgggtggcgaccgggaaagggccgccgtcccacgtgggacggcggccctttcccgcgtcgtaccggggtcagagcaggtcttcacccgtgtcgtcgtagtccgcctgctcgccctcggggttcagcgggtccgcgccggtcagggcgaggaccaggtaggcgccgtagggcgagccgtcctgctcgtccctgacgttcagcgctccgccgaggccgtcctcgtccacctcgaacgccgccggatccaggccgagccgccgcgcgagctcgtccaccgcggcgagcagccggtcgcgcgtggtcccgccctccgcggccccgcgctccggcgggggcaacaccacgaggagatcggcgaggtagccccggcgcagtccgtcaggaccggccgcctcgaactgcatcgagaccggccggagctcggagaccagcggcagccaggcacgcagcgcctcctccgcggtgcgcacccaccccaggttcagtgcgacgcggcagaccacgtcgtcgggggagaaccgcatcagtgggtcacgtatcccttcttggagatgttggcgtgggagtagtccttcccctgattcttgctgcccgcgaacgtctcgaagcccttgcccttggggatctggacgtcccactcgtccttgccgtccttggcccgggtccagatgttgccgtatttgtccgggaagccaccgccccgcacctggggccgcttgggatcccatcccttcggcgggacgtacgggatcggtccgtcggtgggcaggtcgtacttcttggcggtggcgagccagttcttgttcttgtaggccttgcccgagtcgccggccagcttgttcatcttcgagagcgcctcgccgtactgactgggcgagaggtgcttcacgctcttgatcgcgttgccgacccagtccaggtcgtcgacgtacttggcgaggtgctcgaactcgtcgaggtacttcgcgaacttcgccggcttggcgagcgcgtcgcccacgtaggggatgaacgcggccagcgagaggcccgcaccggcgtagtcgccctggaagaggctgatcagcccggacgacccgtcgctgacgggtgtcgggtcgaacatgccggtgatgtcgaggaccagcttggccttgtcggcggccgacagaccgccctcgccctccagatcctcgtccggcgccggatagtccttctggccgtcgccttcgacggggctcggctcctcgccctgctccttcagctcctcgatgagcttgtccagggcggacttcagggcctcgcccgccgccttggcggcct

SEQ ID NO: 4274 - DNA, 3594 bp, Unknown
  Kingdom: Bacteria, Phylum: Actinobacteria, Class: Actinobacteria, Order: Streptomycetales, Family: Streptomycetaceae, Genus: Streptomyces
cccgtacgtacgggacgtcctcgaacagcagccggtcgctgatccggcccttcatggcgaaccgccccgcgacgtgccgctggctcgcggccaggacggagaccgcccacagcggctgctcgtccagcaggtcgtccatccgggagccgttgcgcaggctcaccatcaccaggggtggttccagggacacggacatgaaggcggtcgccgtcatgcccacgtcctcgccccggccgtcctcgtcgaggggcggctcctgggcggtgaccagcaccaccccggcggccagccgcgcgagagcggcgcggaactcgtcattgctcactccctcagcatgggggatgggttcggggcgcggggtgggaggcttcgtctggagcacacccagacgctaaccgccggggccggacggcggcatcgggccaggggaccaggccggtcctaggactccggtaaggaccgcgtgcgcgggtgcgcgagcggtgcgacgagcgggcgcacacaacgggaaccgacccctccccgtacgcaccgaacgagagccgtcgccgtgagtcaccggcacccctcggtcatctgttgtgacttgagtcacagagtccattttctgctgaccctgtgtaccgggtgcacagctcactgtgattcagtggccgtgacactgcaacaagtacgtcgatatgaaacctggagttgctgtcgaggtctcggggagtgcgagcgatggaggccgagtcggaaccgtacgtccgccttgcgaccatgcggcagctgcatcaggccgtcgctgatctcaatacggcacggagtctggcggacacgctgcagaccgtggccgacgggatcgtcgcgggcctcggctacgagctgggctgcgtgaacctggtccggccggacggcgacctcgtcatcgccgccttcgcgggcaacgccgcggcggaggccctgatcaccggccgcgtcggctcccgcacctcctgggaacgccggctctccatgggtgaggcctgggacaacctccgcttcatcccgcacaccgagggctgggtcctcctcgacgacgacgtaccccagtggcacaccgaggggcccgaaccacggttcgaggacgagtggcacccgctggaccggctctacgccccgatgtacgcctccgggggcggccgggacctcctcggggtcatatccgtcgaccggccgcgcaacgggcgccgccccggagcgtgggggcgcgaagcgctccagatgtacgcctcccaggccgccatcgcgatcagcaacgcccggctgcgggccaacatgcagcgcgccctggtccgcctggaacgggagcagcaggcgctgcgcgccagcgaggagtccttccggcaggccttcgagtacgcgcccagcggcatggccatcgccgagatgggcggcgaccagcacggccggctgctgcgcaccaacgacgccctgtgccggctgctcggccgtcccgcctcggtgctccgccgctactccttcgccgatctggtccaccccgaggacatcggcaccctgctgcgcacctccgccgagggcggccgggccgagctgcgcctcagccgccgggacggcacgtatctgtgggtgtcgctgcgcaactcggtcgtggccgacaccgccgacgggccgcgcttcctgctcacccacgtcgaggacatcgaggagcgcaagcggcacgagctgaacctcgcccaccgcgcctcgcacgacgcgctgaccggactgcccaacagcgccgagctgaagtcgcggctcagcgcccggatctgtgagcggccgcactccccggccacgaccgcgatcgaggcgctggacgcggcgtacggggacgtcgagtcgtccctgacccacggctaccagcccgacggctacgagggcgaggcggtccccggcggcggccccttcgaccaccatgtgcacgcggtggccccggatccggaacacgacgacgggacgaaggggctggcggtcctcttctgcgacctcgacggcttcaagtccatcaacgaccgcttcgggcaccacaccggcgacgccgtgctcatcgaggtcgcccggcggctgagcacgtgtgtgcgggacggtgacaccgtcgcccggctcggaggtgacgaattcgtcgttctcgccgacggcctcggagcggcggacgccgctgacctggccgttcgcctgagaaatgccatcattccgcccataagggtcgacggtcgcgcggtccgggtcggggcgagtttcggcatcggctgggccgagtgcggcatgaccgtcgaagaggtcctgcgctccgccgaccagcggatgtatgtggagaagcggtcccggtcgaaggttcaccgcagggccggatgacgttcacgacccgtttctccccctaccccgtacccgttccccgccggtcgtcccgcccgttgagcacaattcggggcctgctccgttcgaggtaggctcggccggtcggcgacggctggcgacatggtgaggagtgacccagggatgacggccggaaacaacggcgcgagcaagcccgaggacgacgatccgttcggctatctgtacgcggacggacaagcggcaggcgcccagccgcccggccagggcggctacggctacccggggccggccgcgcagccgggcgtgcccagaacgtcctacaaccaggtgcgggccgtcggcgaacgccagtacggccagcagcaggccccgcagcagcagggcgggtacggctacccgccccagcagaactacggccagcagcccgcgcagcagtacaaccggcagaacccgcagtacgcggcccccgagacctacccgggcggcggctccaacgggcagcctccggcgcagggcggccatggcggcggtccgggccggggcggtccgaacaccagggcgctcctgatcgcggcggtcgccgtggtcgcggtcgtcctcatcggcatcggcgccgccctgatcacgggcgacgacggcgacaaggacgacaagaaggacgaggcgtcctcctcgcagggccccgccggcgaggtcgaggagtccaagaagccggagaagaagcccaaggagaccccgaagccggtcgagctgccgaagcaggacgcggcgacgctgacgctgggcggcacggcggccctggactccacggtcaagggtgccaagggcgcgaacggcaactacatcaacctgaacgaggtcggccggtcggccacctggacggtcgaggttcccgaggccggcgcgtacaccctgtacgtgacctacggcgtgcccggcaaggacgcgaagacgaccctgacggtcaacgcgcaggagccccgctccatcaacatgaagaacttcgcgcaggccgccgagggcgacctggagaagggctggacgaacacgtacgcgtacgtccagctcgacaagggctccaacaccctcaagctgtcgtgcgagacgggcgacgagtgcgacgccaatctcgaccagctggagctgaagtcgggccacatcaagagctgagggccacgcgtgtgagcgacgacgccctgaccgcccccgaggtggtcagggcgtcgtcgctca

SEQ ID NO: 4275 - DNA, 1392 bp, Unknown
  Kingdom: Bacteria, Phylum: Actinobacteria, Class: Actinobacteria, Order: Streptomycetales, Family: Streptomycetaceae, Genus: Streptomyces
cgcgcccgttcccaggccccgggcggcctccccccggtcgccgcgcgcctcggcggccaggcacagcgcctcgatgcagccgcgtccgccgcagccgcagagcgggccgtccaactggagggtctggtggccgaattcgcccgcccccgtccgtgcgccccggtgcacctcgccgccgaggaccaggcccgcgcccagccccgtaccgaggtggaggtaggcgaagtcgccgcgcggctcgtcgagcgacagcgccacggcgagggcggcggcgttggtgtccttgtccagcaccaccggcagcccggtccgttcggccagggcggcgcgcagcgggtacccgtcccactgcgggaatcccgtgacccggcgcaggacgccgtcccggtggtccagcgggccgggtacggcgacgccgacgccgagcaccggcttgtgcggttcggcggcgcacaggtcccgcaccgcgtccgccgcgtccgcgaggacccggtccgccggagcgccgaggtcgagcggcgcacgggtgaccgcgaccgggcggcccgcgaggtcgaccaggacggcggtgagcccgtcgcggtccaggtgcagcccgacggcgaactgcgcgtcggggaccagccgcagcacggtgcgcggcttgccgccggtggagggacgcaggcccgcgccgacggcgagaccgtcctcccgcagccgggcggtgatcttgctgacggcctgcggggtgaggccggtgccctcggccagctccagcctgctgatgccctccgcaccggcggcccgcagcaggtccagcaccaacgcggcgttgtggtggcgcagcgccgggagattcacccccgcaggggccttcgtcctggtcctgttcacggctcgctcctcttcacggccccattgtgccggtcgcttgcactttggcaacagcgttgcttaagtggaatgcatgacccccaacgcctccgacgccaccggcactcccctccgcgtcgccctcgtcggctacggcctggccggctccgtcttccacgccccgctggtctccgcgaccgagggcctggccctcgacacggtcgtcacgtcgaacgaggaacgccgggccgaagccctcgccgccttccccgacgtccgcctcgccacctcgccggacgagctgtgggagcgcgccgacgagctggatctcgtcgtgatcgccaccccgaacaagacgcacgtgccgctggcgacggccgcgctgaaggcgggccttccggtggtcgtggacaagccggtcgccgggaccgccgcggaggcgcgcgagctcgcggctctcgccgaggagcgcgggctgctcctctcggtcttccagaaccgccgctgggacaacgacttccgcaccctggccgggct

SEQ ID NO: 4276 - DNA, 933 bp, Unknown
  Kingdom: Bacteria, Phylum: Actinobacteria, Class: Actinobacteria, Order: Streptomycetales, Family: Streptomycetaceae, Genus: Streptomyces
gtggacttgccggctccgttggaacccaccagaccggtcacacccggtccgatgtccaacgtgagccggtcaagcgcggtcacgcgggggaaccgcatgctcagggcttcggtagcgattacggctgtcacggaaatgacgttagtggcgcggaccacaggggtcgtcagccctgacggctggatacgcatcagactccaggtgtacgcgcccgtagggggaccccgtgaaggacgaggccggaactccggggcgggcggcgctgccggggtccaccgggagccggcggcctcccacgagcggggccgaagctttccacagccgggcgccgatggttgtccacaggacgtacggcccccttgacgcagccgccggacattgtcacattcatcagtgtcacgttacgggcacgtaccgcacacggcagggaacggacggtggcatgaccggcatggcctcggcagtgcagcacgaaatcgccccggagctgcgggggttcagggaagtgcagcgcctggcctatgcctgcgcggaggcggtcgccggccagttgcggtcgggggtgaccgagcgcgaggcggcccgcatgcagcgcgtgtggctgcgcgagcgaggcgtgcgcgactggttccacctcccgttcgcctggttcggggaccgcacggcgttcgccgggttcaaggtgccgccgcagttcttcccgaccgaccggaagctggagccggggatgccgttcatcctcgacatggccccggtgtacaagggcttcaccgccgacgtcggatattcggggtgcctgggcctcaacccgctgcacgacaagctgctgggcgatctggaggcccaccgcgagctgattctgcgggaggtgcgcgagcgccgttcgctgcgcgagatctacgaggacgtcgaacacctcatgaccgcgcaggg

SEQ ID NO: 4277 - DNA, 802 bp, Unknown
  Kingdom: Bacteria, Phylum: Actinobacteria, Class: Actinobacteria, Order: Streptomycetales, Family: Streptomycetaceae, Genus: Streptomyces
cgcgacgaggacgccgcggcgcgggccggatggtgcggcgtgatgtcgctgccccgcgtcgtcacactcgccgccgacggcggtctggcccaggccccggttcccgaactcacccggctgcgccgcgattcggtccacaccggcccgttcaccgtcgccgacggctcctacgccggactcgacgccgtacgcggcgaccagctcgacatcgaaaccaccctgcgtctcgcccccggcaccaccgcccgcgtcaccgtccgcgcctcggacgacggatccgagcgcaccgtcgtcgaagtggcccgtgcgcgggacggcgccggcacgctgcgcctgcaccgcgagtccagcagcctcgatcccaccgtcgacaccgaaccccggtacggagaactgccgttgggcgggaacggcgaggtcgacctgcgtatcctcgtcgaccactcggcactggaggtcttcgccgggggccgggccctgaccgcccggatctaccccaccctgcccgacgccctcggcgtgggcatcgaggcggccggcgagatcgccgtggaacggttcgacgcctggcagatggccgcgatcttcgacggaccgcgcccgctctggccctgaacggccaccggagcctgtcgggtgacaggctctcaccccctctgaggagacgacgatgtccatctctcggcgcgcgctcatctcgacggcaggactgaccctgttgaccccccttcccctcatcggccgtgccgtggccgcgacacggacggtcgcatccgtcccggacccgacggccttccccatc

SEQ ID NO: 4278 - DNA, 1056 bp, Unknown
  Kingdom: Bacteria, Phylum: Actinobacteria, Class: Actinobacteria, Order: Streptomycetales, Family: Streptomycetaceae, Genus: Streptomyces
gttctccaggagttcggcgaggaggtggctgaggtcgtcggcggcgaacccggcgatctgggcgtgcggcggcagggactggatggtgacccgctcgtaccgctcgatctcgctgacggccgcgcgcgccacgtcgaccagcgggatcggccccgcgtggccgtggccgtgctcggcgcccgcgaggacgagcatgttctcgctgtggcggcgcatgaccgtggccatgtggtccagcttgaagagggtggccaggcgctccgggtcctgctcgcgctcctccaggccctcgatgacgccgagctgccgctcgaccagtccgagggtgcgcagggagaggttgacgaaggtgtggttgaccgtgttcctcagctgctccagctgggtggccagctcggtcgcccgcgtctggagttcggcccgctgggcgacgagggtctcccggcccgcgatcagcttggtgcgttcgccggtgaggctctcgacgcgtccggtgacgtcctggtgcagggtggtgagcctgccgtgcagggagttcatcgaccgtacgacctgggcgaactcgtcgttgcggccggtgtagcggaccggttcggcgctctcggggtcctcggcgaggcgcgcggcgccgaggcgcaggacggcgagcggctgggtgagggtgcgggcgacggcggtggagacgccgacggcgagcaggaagcagccgccgagcagggcgatgctcagttcgagggcggtgacgtcgtcgtcgcggaggccctccaggtcctggacctggccggtggtcagggccgactcgacgctccgcagccggtcgacgcgggcggagagcgcggcctccagcttcttggggctgatcctgcgctccgcctccgagagctcggggcggtcggtgaggcgggtgaggtacttctccgcgtcgttgacctcggatccggtgacggtggcggagagcttgtcgcgggcctccgggtccgccgcctggtcgaagtcggccagtgcggccagctcccggacgcgggcctgctgggcggcggcgctcagctcgtcgcg

SEQ ID NO: 4279 - DNA, 703 bp, Unknown
  Kingdom: Bacteria, Phylum: Actinobacteria, Class: Actinobacteria, Order: Streptomycetales, Family: Streptomycetaceae, Genus: Streptomyces
agggtgtcgagcgcggattcccggtcgttctccgcgctgtgcagcagagccgtcacccaggagagctcctccagcgccgcaccgctcgcggccgccgacagccgggacgcgtggtcgacatggcggttggcctccgtcagctcgttgcggtggaccgccacccggatgcgcagcgcgagcggtccgacggcgagggacggcgcggcgagccgctcgcagatgcgcaccgcctcgacggcgtcctcgtcggcgtcgtcgagccttccggccgccagcttcaactgcgcgcggtggtagtgccacatgggccgcacccagggcagcgccacatggtcggacgggtcgcaccgctcggcgaggatctccccggcctggtcgaactcgtccgaggcggtcagcgcgatcgccagccacagttggtggtgggcccggttcgtccggtccccgtggtcacgcgcgatccggagcgccgcacgggcgtgcgcgaccatctgcccgtggaggccctgtacctgggcggccgagtaccgcagcgtcgttcggtacatcagctcggcgtacggggcggacggcggcgcggtggaagcggcggtactcctggaggccagggcgagctgcccggccggcggcacgaaccgggcctcctggcgcggggcggccggggtgaggccgtcaccgtcgccccgcaggccgagcatcaggt

SEQ ID NO: 4280 - DNA, 609 bp, Unknown
  Kingdom: Bacteria, Phylum: Actinobacteria, Class: Actinobacteria, Order: Streptomycetales, Family: Streptomycetaceae, Genus: Streptomyces
cgccggggtcccggcctcctcacgggcgaccgcggcgccgatgcccgccgcgagctcctcgcccggaccgccgggtccgccggaacccgacagatgttccatgacccgggccagggtggggacggccgggtcggcggcggagacccgggggacgccgagggtgtccaggacccggtgcaggcgggccgcttccgtacgccacttccggtcgacgacctcgtcgggatactgctgccagtccaccggcgcccagcccggaccgctcgcggcggggccgccgtggaagagccgggcggcgagcagggacgccgcctcgtcggccaccccgggctcctccagcaggtcgcacgcgggccgctcgccgaggcgcagggcgaagccgtcggccagccggtcccggcgggagagctcggtcagcgcggagacgaccccggcgtccagccgggagggccagcggcccatccgccaggcgggaagcgccacccgggtcagcagccggtcccagccggcataggcgaggccgacctgttcctggacggcgatccgcagcccgtggtcgaccgtctgggcgcgcatggacgcggccgccgccacgcagcgctccatctc

SEQ ID NO: 4281 - DNA, 705 bp, Unknown
  Kingdom: Bacteria, Phylum: Actinobacteria, Class: Actinobacteria, Order: Streptomycetales, Family: Streptomycetaceae, Genus: Streptomyces
tcccagcgcaccgggaccagcggcgcccccacgggcagcagggcggtcagcgcttccggggtcacgccgtcgtccgcgccggggcagtagagggcggcgtccggcggcacgggcaggtccccggggtccggaagcggcgcggagtccccgagcggcagcagccgcaggcccagccgggaggcggtggcagcggcggcgtcgaagtccggggtggccagcgtgagaccggtgatcccggcccggtgcagtccgcgggcggccggcagcacggcatcggccggaccgcacagcagcacctcggtggtgcgcagccgctggaaaaccgcgtacgggtcggcgcactccgtctccaggtgcgccagtgcctccgggtagcgggcgcggatctcggccgacggctcgggcacggtcagcgcgcccaggtcgagcaggagatcgcgggcccgcagctcgtcgacgatccggcggacgacgggccgggcccgttcgctgcccagcgcgctgaccagctcgtcctcggtggttcccgcttccagcagcggcacacaggtgtcggcgacccggtagagcagttgggggccgctgatcacgaactgggtgcgggggccgttgaagtagaccccttccgtgaccggcgcatagtgcagatgggggcgcgcgcgtagcgtcatcgggtctttcctccgtactggaaggggccgccgg

SEQ ID NO: 4282 - DNA, 1749 bp, Unknown
  Kingdom: Bacteria, Phylum: Actinobacteria, Class: Actinobacteria, Order: Streptomycetales, Family: Streptomycetaceae, Genus: Streptomyces
ggtccggtgcgcggagcctccgatggggagccggcggccgggggcgcgggggaggccgacggggacgggctcggatccggcacggcctccagcacctcacgggcgggtgactgcacgatctgcggggtcacgtcctgggccggcccggtggcacccggacgaggggaaggcagggctcggggctccaccgacacgcagccggagatggccgtgacggtcagcccgaccaggaggttcgcggtgattctggttctctgcacccgggtaactctgcggtgcggcgcggccttcggagacccggtgggcggggaatggcccgcacgagtgacccggtcagcacggcgcccggcccgtgctcgccggggacgtgaccgtcagtcgccggtggcgccgtccacacgctcgcgcaccaggtcggcgtggatacaacgggttcggagcgttccgaaaagtcgtggggccccagtagctgatgatcatggccctggccagggggttcgtgaacggaccggcaggagggcgcgggacggcggcgacgtatgctgccggggcgcgcacagccgcgcacggcggcgcggcacggcgacagggagacctcgtgaagatcggttgcatcggcctcggcgatatcgcgcggaaggcgtacctgccggtgctcaccgccgtaccgggggtcgaactgcatctgcagacccggacccccgccacgctccacgcggtcggcgacacccaccgcgttccggccgacggccgccacgcgaccctcgactccctcctcgccgcggggctggacgcggcgttcgtgcacgccccgaccgccgtgcacccgcagatcgtgggacgcctcctcgaagcaggcgtcgccacctatgtcgacaagccgatcgcctatgagtacgccgactccgagcggctggtgaacctcgccgaggaacgcggcgtcagcctcgccgtcggcttcaaccgccgcttcgccccgggctactcgcagtgcgcggagcacccgcgcgagctgatcctcatgcagaagaaccgggtcggactgcccgaggacccccggacgatggtcctcgacgacttcatccacgtcgtcgacaccctgcgcttcctggtcccgggcaccgtcgaccacaccaccgtgcgggcccgggtcgtggacggcctcatgcaccacgtggtgctccagctgtccggcgacggattcaccgcgatcggcatgatgaaccggctgaacgggtcgaccgaggagatcctggaggtctccggccaggacaccaagcgacaggtcctcaacctcgcggacgtcatcgaccacaagggccagcccagtgtccggcggcgcggcgactgggttcccgtggcccggcagcgcggtatcgagagctgtgtgcacgccttcctcgacgccgtacgccggggtgagacgctcagcgcccgggacgccctggcgacccatgagctgtgcgagcgggtggtccgggaggtgctggagcaggcctcctgagcgcccgcagcccctcgacgccgcacagcacggccagcgccgccagcgccccgtacaccggccagtcgccgagccggccgtagagcgtgctcccgcgcgccagcggcaggtcgaacacctccgccgcgctcgcgtccgtaccgagcgggcggcccacccgctccccccggggtccgtacgccgcactgatcccggtgagcgtcgcatggaccatcgggcggccgttctcggcggcccgcagcgcc

SEQ ID NO: 4283 - DNA, 872 bp, Unknown
  Kingdom: Bacteria, Phylum: Actinobacteria, Class: Actinobacteria, Order: Streptomycetales, Family: Streptomycetaceae, Genus: Streptomyces
atacgcgatcatcaccgcggctgcgctgctggaccgcggtgatgatcgcgtatccgtgcagcggggccggttcgagaaccgccaggaggagaccgtccagatgtccgcgtaccgcatcctgcctcatgcgtaggcaggctacacatgagcggcgtggagggccagcggccctgggtgaagggtcgccgtccgaggtggatgcgtaggcagactacctatcgagggcggatcgtgctattcctggggcggcggcccatacgtttgcagccaacctatgggtcggccgtccgcggccgcgcaatcccttgccctcgccaccactgccactgccactgtcgttgccatgcacccttggagggacccgtgaccaagctgctgctctcgctgcacgttctggcgtcgatcctggcggtcgggccggtcacggtcgcggcctcgatgtttccccgctacgccaagccgcctgcccccggcagtgagggcccgcacgaccacgacacccgcacggcggcctttctgcaccggatctgccggacctacgcgctcgtcggcatcgccgtacccgtcctcggcttcgccaccggggcgcagatgggggtgctgggagatgcctggctgctcgcgtcgatcgtgctcacggcgatcgccgccgccctgctgatggcgatggtcctgcccggacagcgtgagctgctcatggacgcgccggtcgccgagcgccggtcggcggcgacgcggctcgccatgaccaccgggatattcaacctgctctgggcgacggtcgtcgtgctgatgatcgtccggccgggatcgacgacgggggcctgacccgaggagcggtcggcttcgggaccacctgaaccgctcacctg

SEQ ID NO: 4284 - DNA, 1603 bp, Unknown
  Kingdom: Bacteria, Phylum: Actinobacteria, Class: Actinobacteria, Order: Streptomycetales, Family: Streptomycetaceae, Genus: Streptomyces
acgccacggccgccgccctggtcggcggctccgtcccgctggtcaccctgaagatcgccgacgcgctctcgggcaacgtcctggtcggccaggagaacgtggccctcgcactgagcctcgacatgatcgtgatcgccggactggtgatggcggtctacctgcccctccagcgacggagttcccgatggctgcgctgacccctgcttccacggccgccgtccccgccacggtgcgggcggcccgccgccgcccccgctactggcgcggagccgtgctcaccgtcgccgggctgtacttcctcaccccgctgatctcctcgttcgtcttcaccgtccatgtgccgaaccagggcctcaccttcgccgcctacagcgggatcctgtcggccgacggcttcaccgagagcctcttcctctcgctctccctcgccgccgcgacgatcgcgctggccctgctgctcgtcgtgcccgccctggtcgcggtgcggctcgggccgccccggctgcgcgccgtcgtcgagatcgtctgcatgctgccgctggtggtgccgccgatcgcgctggtcaccgggatcgccacggtgttgcgctgggggcccgaccacttctcccgcaccccgctctaccagaccttcctcgccgtgcagaacgagtcgttccccgtggtgctggtcctcgcccacaccgtgctggcgctgccgttcgtgcaccgctcgctggacgccggactgcgcgcggtcgacgtgccgacgctggtggaggcggcccggaactgcggggccggccgactgtacgtgatcctccgcgtcatcctgcccaacctgcgctcctcgctcgccggggcctccttcctgaccctggcgctggtgctcggcgaatacaccgtcgcctcgctgctgggcttccgccccttcgccgtgtggatcgtctccgtctccggcgccgaggcccggatgtcggtcgcggtgtccctgctcagcctgctgatcacctgggccctgctgctcgtcctctcccgcgccggaaccggttcgtccgccgccgttcccgccgcggcccccacccccgtacccggcaaggagtagccacccatgtcagccctgcccaccgccgcccgacgccccgagccgtcctggcccgcgtcgtccgccgaggcgcacgacgccaccggagcccgggtggagtttcgctcgctgcgccgggcgttcggcccgaccgtggctctcgacggactcgacctcaccgccgaacccggcgaactgctcgccctcctcggcccctccggctgcggcaagaccaccgcgctgcgggtgctcgccgggttcgagcagccggactccggcgaggtcctggtggacggcgaggacatcacgcggatccccgccaaccggcgcgacgccgggatggtcttccagtcctacagcctcttcccgcacctgaacgcccgcgacaacgtggccttcggcctgcgcgtacggaaggcgcccgccgccgagcggcacgctgtcgccgccgacctgctcgacctggtcgggctgcccgaccacggcggacgcttcccgcaccagctgtccggcggccagcagcagcgggtcgccctggcc

SEQ ID NO: 4285 - DNA, 1120 bp, Unknown
  Kingdom: Bacteria, Phylum: Actinobacteria, Class: Actinobacteria, Order: Streptomycetales, Family: Streptomycetaceae, Genus: Streptomyces
tctgggcggtcggcgcggcctcggcggtggccctggtcggcgtcgccacgcgcatcccgcacatcccgctgcccgagaagaagcccgagctgaggcgggagctggcgatctaccgggaccggcaggtctggctggccatcgtgatcaccgcgctcgcggcgggcggggtgttctgcgcgttcagctatctggcgccgctgctcacggacgtggcgggcctcgactcgggctgggtgccgtggatcctcggcctgttcggcgcgggtgcgctgatcggcacgatgatcggcggccgggtcgcggacgcgcacctgttcggggtgctgctgagcggcatcacggcgtccacggtgttcctggtggcgctggccctgttcgcctccagccaggtcgcggtcatcgcactggcgttcctgctgggcctgtccgccttcttcacggcccccgcgctgaacgcccggatgttcaacgtggccggggccgccccgacgctggccggggccaccacgacggcggcgttcaacctgggcaacacgagcggcccgtggctcggcggcaccgtgatcgacctggacttcggcttcgcgtccacggcctgggcgggtgcggcgatgacggccctggccctggcggcggtgggggtggcgctgcacctgcagcgcggcggcgagggcggccggccgcgttcgcggctgatcgcgaggagcgcggcagtgcctaagaacggccgcccggcgccggccgccccttcggcctcctcaaccccgcgtccgtgaggcgcctgaccagctccttcgagccgatctcccgcgccccggcccgcacggcgtccgcgtagtgcgcctccggcacgtcgtagtgatcgcgctcgaaggcgcgcggcgggcacccgatcgcggcggcgaaggcgtgcagctcctcgaatgacgcatcgctgaccaggtgcgaccagaggcggccgtgtccgggccaggtgggcgggtcgatgtagagcgtcaccgccgcagcacctcgcccagcgcccccaccggcgccaccgccacggccgtcttggcgcacacccagtgcgggtcgggcccgagctccggctccacgtcgagcgcgtgcggctcctcctcgg

SEQ ID NO: 4286 - DNA, 1580 bp, Unknown
  Kingdom: Bacteria, Phylum: Actinobacteria, Class: Actinobacteria, Order: Streptomycetales, Family: Streptomycetaceae, Genus: Streptomyces
ggcacagcggccaccgcccgtaccgctccagcagcgcgtcctgcacgtcctgggcgaccagcccggccacgaaatccacgccctcgggccactgctccacccaccaccggcggtgggtcaccgcgtcctcgaccagcgagacgatgtccgcctcggcgacgtcgcccgccgccaggtcggccatgacgagcgcgcgggcggtgtgcagggcctgctccagggggttcaactccatgcacccattgtgcgcccgcgcgggaaaggctccgccagaggtagggaccaaagggggcttgacggacccccgggttgaaaatatctttcagatgtgacccaagacgtgaaggaaattttcagcggcgagtccccgccggcccccgcggccctcgccgccaaggtccggaccctcgccccctccatgacccgctcgatgcagctggtcgccgaagccgtggcgggcgacccggccggctgcgccgccctcaccgtcaccggtctcgccgagctcaccggcaccagtgaagccaccgtcgtccgcaccgcacggctcctcggctaccccggctaccgggatctgcgcctcgcgctggccggcctcgccgcgcaccaggagtccggccgggcccccgccgtcaccgccgacatcgcggtggacgacccgatcgccgacgtggtcgccaagctcgcctacgacgagcagcagaccctcgccgacaccgccgccgggctcgacaccgtacagctgggggccgccgtcgccgccgcgtcgaccgcccgccgcatcgacgtctacggcgtcggggcgtcctccctcgtcggccaggacctggcgcagaagctgctccggatcggattgatcgcccacgcccacatggacccgcacctcgcggtgaccaacgccgtgcagctgcgcagcggcgacgtggccatcgcgatcacgcactccggctccaccggcgacgtcatcgagccgctgcgggtcgccttcgaccgcggggcgaccacgatcgcgatcaccggacggcccgacggtcccgtgacgcagtacgcggaccacgtgctgaccacgtccaccgcgcgcgagagcgagctgcgccccgccgccatgtcgagccgcaccagccagctgctcgtcgtggactgcctgttcataggcgtcgcgcagcggacgtacgagaccgccgcgcccgccctggccgcctcctacgaggcactcgcccaccgccacaacccgcgcacccgctgaccgccccggaacgggccacgcaccacccgtacgcgttcgagaccgagaacaccgagaaagctgagccgcaccccatgacctccaccaccgacgcgaacaccgacacccccgggaccaccggtcccacgagccccaccggctccaccgagacctacggcgagctccgcgcccagctggccaccctcaccaccgaggcgttccgccccgagctggccgagatcgaccggcagtccacgcaggagatcgcgcggatcatgaacggcgaggacgccaccgtcccggccgccgtcgccgagcggctgccgcagatcgccgctgccatcgacgccaccgc

SEQ ID NO: 4287 - DNA, 810 bp, Unknown
  Kingdom: Bacteria, Phylum: Actinobacteria, Class: Actinobacteria, Order: Streptomycetales, Family: Streptomycetaceae, Genus: Streptomyces
ggcgggcaggacaaccggcgttccacgcggccctgttgttccaggtaatcggcgagtcggtaggcgggctcccgggcttcgtcaccccggtacggggcctgggtcagcggacccagcacgccgtagcagggctcggcgcagaaggcgagcgcatcggccatccagtcggggccgagcagggtgagctcccggtccgtgaggtacccctccgccgcctgctccagcaagtcgtgccgcagaaccgggccgtggcccagtcgccggtagtccatggccgcgtggatcagagccgtggccccgggagtcgcggtccggtagcgcgtcatcaggcggggcacaccggcgaggaactgcgtgatctccccgtcggccgcgccggtcagcgcgctctggagtcgcgggtctccgtcggcctgttgccaggcctgctcgatgtcgaggtcggtgaacgccttcgggaccacgatgtggcggccgatccccgtcaggagcttgcgctgctgctcgtacgggtcctcgcagccggtggcggacggggcggtgagcgggtcccagaacctcggccagatcgtcgccaggatcaggacgggagcccgccgtcgatcgtcaagggccgtacgcagggcggaggtgacgctttcggcggtcctggggtcctgggcaaggaggtagtgctgtgcttcgttcagccagatgaccgtccggggcgagacctccttgatgtggtggagggccgcgtcggggcgggacgggtcgtacgggtgccatacgcgccatccctcggggagccggcgcagcgcctcccagcag

SEQ ID NO: 4288 - DNA, 518 bp, Unknown
  Kingdom: Bacteria, Phylum: Actinobacteria, Class: Actinobacteria, Order: Streptomycetales, Family: Streptomycetaceae, Genus: Streptomyces
gacttcgtcgtgcacggcgaaggtcccgcggaggcctggtccgcttcggcgcgggagggcgacgagctgtggttcgtcgggcccaagtcgtcgctgcggctgccggaacgactggactggatcctcctcatcggggacgagacggcactgcccgcgatcggccgtttcctcgacgagcgcaccgtcgacgccccggcgcacgtcctggtgaccgtctcggacgacgcggcacgccaggagctggcgctgcgcgacggcgacacgatcacctgggtggtcgcggagccgggtgacgcggaggcactggacgccgccgtccgcgccctgccgtcgccggtgggcgagggattcgcctgggcggccgcggagagccgggcgctgcttccggtacgccggtatctccagcgggagcggcggctcccgaaggaccgtgtgaacatcacgggttactggcatcgcgaggaggccgccgctccggagatgcagggcacggccgacgcctccgcgcagggccctgc

SEQ ID NO: 4289 - DNA, 651 bp, Unknown
  Kingdom: Bacteria, Phylum: Actinobacteria, Class: Actinobacteria, Order: Streptomycetales, Family: Streptomycetaceae, Genus: Streptomyces
cacggtcgaggatcccggcggcgcggatccggcgagccgggagagggtcgcgctcgccgagggggaagtggccggctgggcgcgcgggatcggcgtgtggtgggcgccggtcgccgtgctggtgttcctggcgaccggtgtcaccatcggcctggaggtgagctggttcgtcgggtcgccgctgtttctcctcgccctggtggcggccaccttctgccgcccccacgtggcggtggaccggcggggcctcaccgtctccggtctgctgccccggccccgggtgcgggtgccgctggagcggatggcgggggcggacagtcgaagcgtcaacgcgctcgcggaatacggaggttggggctaccgcatccgacccgagcgcagcggggtcatcacccgctcgggcgaggccatcgtcgtcagcctgacgagcggtcgcgagttcgccgtcaccgtcgacgactcggccaccggcgcggccctgctcaacaccctgctcgaccggcagcggacggggcgctgaccatgctcttccgggtcgatccgacctccaccgtcccgctcggcgaccagatcgccgcctcggtccggcgtgcggtcgccgagggcacggtggccccgggcgagcggctgcccgccgcccgggtgctcgcc

SEQ ID NO: 4290 - DNA, 1553 bp, Unknown
  Kingdom: Bacteria, Phylum: Actinobacteria, Class: Actinobacteria, Order: Streptomycetales, Family: Streptomycetaceae, Genus: Streptomyces
cctgagcacctgccgggcatccccgacggcgcaccccggcaggaggcgggccgcagcgggcgacccgctgcggccgggcgcacaggagcgccccggcgggaccaaccgtcccaccggggcgcgcgatccgctgaggccgctacggagccgtgaccgtcaggtcgccccggcgcggggaggcgaaggcctccaggtccgcgcgggtcaggccggtcagcagggccacctcggcggtgtccagcgcgccgcagtcgatgccgcgcagcaggtagccgctgagggccttggcggtggcgggctcgtccatgacgtcaccaccggccttggccacataggcggcgagccgggcggcggcgggctccagaccctcccggtagaaggcgtagacggccgcgtagcgcgtcggcaggtggccggggtgcatgtcccagccctggtagtacgcacgggcgagagcgcggcgggtgaggccgtagtggagccgccaggcctcgtggacctgggcggccggacccacgggaaggacgttggtcgagccgtcggagacgcgtacgccggtgcccgcggcggcgacctgcatgacggccttggcgtggtcggcggcagggtggtcgctggcctggtaggcggcgctgaccccgacgcaggcgctgtagtcgaaggtgccgtagtgcagcccggtcgcccggccccgcgcggcgtcgatcatgcgggccacggcggcggtcccgtcggcggccaggatcgactggctggtctcgatctggatctcgaagccgatgcgtccggcgtcgaggccgtgcgccttctcgaaggcttcgaggagccggacgaaggcggtgacctgctcggggtacgtaaccttcgggagggtcagcaccagcccttcgggcagacctccggccgccatcagcccgctgaggaagacatccgtggtgcggatgccccggtcgcggacaccggcctccatgcacttcatccggatgcccatgtacggggccgcggtgtcgttcgcgtacgcctccgaggccagccgggcggcacgggcggcggcctcgtcctcctcggcgtccgggcgagggccgtagccgtcctcgaagtcgatgcgcagatcctcgacgggctcgcgctccagcttggcgcgtacccggtcgtggacgggacccgccaactcctcggggatgccgagaacagcggcgaacgacgcggcgtcgggggcgtgttcgtcgagggcggccagcgcctggtctccccaggagcgcagggtgcctggcccgaagacgtcaccgggtacgtagacggtgtgcacgggctggcgggtgccgggatcgcccgggtagcggcgggcgagttccgcgtcgaccgccgtgagggaggcactgatctcctcgctgaccgcaccggcgaggctcgttgccaccttctcctgctgacccatgaccataccctccacgctctcgctgtttccgcttcccggaatcaacaatccgtatagtgaagttataaggccgctcgacctgcgtcaatggtcgcccggaacggccgcgggccgc

SEQ ID NO: 4291 - DNA, 2760 bp, Unknown
  Kingdom: Bacteria, Phylum: Actinobacteria, Class: Actinobacteria, Order: Streptomycetales, Family: Streptomycetaceae, Genus: Streptomyces
agctcagggtgtgcgcggcgcacggccgcgtcgatcgtcgtcgcctcgacgccgcgctgctgcccgcgggttcccgtcggatgtctccgacgccgcgcgcatcgccgcgtagacctgaccgcgctcgagcagatcgatgccggccccatgggcgatgagccgaccccggtcccacgggatgcgccggaagagggcgtccacctccgcgggagcggagacgaggatcgggtccaggagcgacggcggcgttctcgtcgagccggccccgggttccggcggcgtcgcacagcggaaggaccgcactccacagcagcaggtgtctggccaggtcctcccggatcaccgcaagatgggcttctccgatcgagaaggtgaacgtgcggggctcatggttggcgtcggccccggcgccgagcatcagcttcagtccgccgtcctcgcggatcacgttcgggatccagccgctcatgcgcgtgaaaacaacgtctctcaggggctcggtcctccccatcggacgagaccagcgagaccttcctccaccgatccggccggccgcgttcgggtaccacccacaccctccggagcgagcgggccccgtcactcgtgatcggatgcgccgtcgtgcgcaaggcggtgaactcggctcgtgcgttgcggccaccaggcctcgaaatatacccccgggggtaagagtgttacggtgaatcgcatacccccgggggtaatttttcgtcggaaggagactcccgtgttcttcgttgaagccatcgagctcgagggcttgggcaaccgcagctaccttgccggcggccgtcggacggcggtcgtcgtggatccgccccgtgacatcgatcgggtgctggccgccgctgcccggcgtggcgtggcgataacccaggtgatcgagacgcacatccacaacgactatgtgaccggcggtcttgagctggcccgcgtcaccggagccgcctaccgcgttccggccggcgcacacgtctcgttcgcccggaccgcggtgtccgacggcgacaccgtcgtcatcgacgcggaactggtcctggccgcggtggcgacacccgggcataccccgcaccacatggcttacgtgctgagcgaggcgggccggcccgtcgccgcgttcaccggcggctctctcctcatcggcacggtggggcggcccgatctcgtggagccgcggctcaccgagcagttggcccgcgcccagcacgcctccgcccaccgcctcgcggactccctgcccgacgggaccgaggtgctgccgacgcacggattcggcagcttctgctcgtccgcccagaccgacggggagacgaccacgatcggcaaggagaaggcggccaatccggctctcaccgtggaggtggacaccttcgtcgccgagctgctggcgggactggaggacgtgcccgcctactacacgcacatgagccccgccaacacggccgggcccgcacccgtggacctgaccgcgccggccctcgccgaccctcacgacatcgccgcgcggctcgcggcgggggagtgggtggtggatctgcgcaaccgcatcgctttcgccgaggggcatgtcgcggggtcgttcaacttcgaggcggacggcaagctcgccacgtacctcgcctggctgatcccctggggcaagccggtgaccctgctcgccgagtcggccgagcaactcgccgcggcccagcgggagctggtgcgcgtcggcatcgaccggccggccgccgccgcgacagggggccccgcggactggcttcgcgccggcgagagcgtcgcatcctttccccgtgccacgttcgccgaactggccggtcgggagaggggtcggatcgtcgtgctggacgtacgccgctcatccgaacgggcggagggctggatcgagggctcggtccacatcccggtccaccaggtccaccgccgtatcgacgaggtgcccgacggcacggtctgggtgcactgcgccggcggtatgcgtgcgggtatcgccgcgtcgctgctggacgcggcggggcgggacgtggtcgccgtggacgacggtttcgacgccgctgccgctgccggactggccatcgtcaccgaggaagggtgacgtcgatgtccctcttccgtggacgtggacaacgcctgtccatcggcgaggcgcgcatccgcaccggcggggagcgtcccgaagccgttctgctggacgtgcgggagaagtccgagtggcgaacgggccacgctcccggcgcggtacacgcaccgctgaccgccctggccgcgggtgcggagcttccggcggcagcgcgggggaggccgctggtggtgatctgccgcagcgggcaccgctcgcaacgggccgtgaagcttctcgccgagcggggagcggacgtggtggacgtcaagggcggcatgaacgcgtgggccgctgcggggctgtcggtgatcgacgagcacggtgacggcggctcgatagcgtgagcaccttggttctcgccctcgtcgccggaacggtgatcgggctggcgctcggcgcgctcggtggcggtggcggtgttctggcggttccggcgctgatctacctgctcggcttctcggcggcctcggccaccacagccagtctgatcattgtcaccgccacatcggccaccgctctctacgcgtacgccagagacggccatgtcgcctggaaagccggggcgttgctcgcggcggcgggagtcctcccggcgtacctcgccggagctgccgccgatc

SEQ ID NO: 4292 - DNA, 630 bp, Unknown
  Kingdom: Bacteria, Phylum: Actinobacteria, Class: Actinobacteria, Order: Streptomycetales, Family: Streptomycetaceae, Genus: Streptomyces
cggccccacctgcgggcgggtggcgggaccccaggcactaccctcgtcccgtggagctcaagaacatcccggatcccggtttctccgacgacgacggctcggcgtcccccgccctgaccagcgccctggacgtctggtcccgcgaccggagcgccgtcggcccggtcctcacggccctgcgcgacgcccggctcctggtccccgtcgtcgccgtgctcggcgaggtcgaggaggacgagaacgggctccggcgcgagaagaccagcgacatggcggtgcccaccctccaggcgggagaccggcgcgcgctccccgccttcacctcgaccgcatcgctggcgctctgggacccggaggcgcgccccgtcgccgtaccgctgcaccaggccctccaggccgccgcccacgagaaggccgacaccgtcgtgctggacctcgccgggcccgtcgccttcgagctgagcgggcaggcgctcctggccctcgccgagaaccgcaccagcaccgacccgctccaggaccccgccgtcatcgaggccgtacgggagaccgtggccgccgaccccgccgtggtccgcgcccacctcgggcccggcagcgcggacggcaccctcgcgctggtcctcgccc

SEQ ID NO: 4293 - DNA, 1762 bp, Unknown
  Kingdom: Bacteria, Phylum: Actinobacteria, Class: Actinobacteria, Order: Streptomycetales, Family: Streptomycetaceae, Genus: Streptomyces
aggcgagggaggacgcgcagaacggcgccaacccggccgacgaccccgggaacgacaagaacacggcccaggaggacggtgagttcctcggtctgaccaaggaccagtggatcacctactccggccgcgtcagcaccatcgcgggcacgatctcggccgtcgccggtggagccgcgctggcggtcggctggatcccggtcgtcggtcagggcgcggccgcgatcctcggtggcgtctccctcatcgcgggaggggtctccctgctggcgggcggcgtcaacgtcatcgcgagctggggcacggacgacttcaagaagaacctgggcacgttcgcgctgagcgccctgttcttcggcaagggccgagcggtggccgcggtgtccaagaaggtcggcagcagcctgtcgggcatcgccgacgaggtcggcatgaaggtgtccggcttcctggaggacactacgacggcggcgatcggctggttgaactggagttgaccgggcgatgactccggcgggtgggcggcaccgagcgcggtgccgcccacccgcgccgcgtacgcgagggacgggagagggcgagtgcaggcggagagtttgacgacggaccagtggtggatcgtggccgtggccgcgtccgcgttgttcctggcggcggtccactactgcttcaggaaccgcagggcgacggtctgctcgttgatcgcgcccgccatcggagcggtcaccgtcctgggcttcggccgcgcacgcgaccactcggaggtggaggcgctgatcatcttctccgtctccctgctctccctggctctgctgatcgtggccatgcggccggacatggagaagatcagggcgaaggtcctggccggtgagacgtacgagatcccgaagtggaagatcaacctctacggggtgctggtggtggcgtccgcggtggtcgtggtgttcctgctgctgtagaggcgggcagccctgctggaggagcaggaagcccagccgtcgcaggcagcggcgggaacccctactcccccagcttccggcgcagcgcggcccgctccggctcggtgcccgcgagctccagcgcctcccggtaggcggcagcggcctccccgtcccgccccagccggccgagcagatccccccgcgccacgacgtacggcgggtacgcccgcagccggggctcccccgccaacgcgtcgagcagcgcgagaccggcccccggcccgtcccgcatcgccaccgcgacggcgcggttcaacgccaccacgggggacggggtgagcgtgaggagcacgtcgtacagggccacgatctgcggccagtccgtggccgccacgtccgccgcctcgtcgtgcagggcggcgatggcggcctgcaccccgtacggcccggccggcccgccggtcagtgcccggacgaccagggcacgcccctcctcgatcatcggccggtcccagcgctcccggtcctggtcctccaggagcaccggctcgccctccggcccggtccgcgcgccgcgccgggcgtggacgagcagcagcagcgcgaggagcccggcgctctcccgctcggcaggcagcaggcggtgcagtatccgggccagccggatcgcctcctcggccaggtcgagccgctggagacggggtcccgagctggccgcgtacccctccgtgaagaccgagtagaggacctggaggaccccgggcagccgcccgggcagttcgtcggggccgggcacccggaacgggatccgggcctcgcggatc

SEQ ID NO: 4294 - DNA, 1190 bp, Unknown
  Kingdom: Bacteria, Phylum: Actinobacteria, Class: Actinobacteria, Order: Streptomycetales, Family: Streptomycetaceae, Genus: Streptomyces
caaggaccccgcggcgcgcccgcctgccgccgaggtccgccggacgctccagcagctggcctccccggccccggccccggcgacctccgcgtacgggacggtccccgcgggcggaggcggcggcagcaagtgggtgccgcccgtcctgcaccgcaaccgcgtcgcccagttcgcgctcggcggcggtgcgctggcggtcgcggtctcgctcgtcctgctcctgctgaacccgttcgcgggcgacggaccgcccgagggctggcaggtccggccggagaacgaggtcctgtcggcggacgtcgccgtgccggaggagtacaagcgggtccaggaggacgacgacggcgaactggtctggtacgcggaccccagcggcgtcttcgagatcgccttctggcaccggcccgtgaagagcgagaacagttcggacgacaaccccggcgtcgacccggcggcccgcaaggcgtactacgagaagggcggggagagcaccacgcagatggaggaagcctccgtcacgtacaaggacgccacgcacgaggggcgcgaggcggtcgagatgaccaccgagttcgtcccctacgcctcgtccgacgacgacccggtgcgctaccgcttccgggaactgctgatccccggcgagaaggagagcgacccctactggcacgtgcgggtgcggatgcccgccgagggtcaggcggcgaaggacggcgacgcgatcttcaccgaggtcaccgagggactgaagattcacgcttcctgagcgtcgcgggccggccgccgggggtcggtcggccgcatagccactgatcagcggttatgccgccagcgatcactggctcgttcgaggagggtgcccggcaggggtggcgggtcctgtgaaaaactgttacccacgggtacccaaagccttcggctggacatactctcggcctcatgacggactcgcaggcccctgacgcccctctcggtacgaacccggtggcggccacccccgccggtgtgcgcaccgccgccgacgtggtcacccccgaggtgatcgcccagctgatccgcggcgtcgtcgggtcgggccgcacggccaaccacacccccttcaccggggagaagctggccgacctgcccgagtccacccccgaggacgtcgccaccgccttcgaccgggcccgcgccgcccagcccgtctgggc

SEQ ID NO: 4295 - DNA, 931 bp, Unknown
  Kingdom: Bacteria, Phylum: Actinobacteria, Class: Actinobacteria, Order: Streptomycetales, Family: Streptomycetaceae, Genus: Streptomyces
cggcggggcagggtgctgcggttcatcagggactcccgttgcgggtgtgtggcccgggcgttgcgcgcgggcgcgaagggtggtcagacgatgtaggcgtggcggcgcagcagccggacggcgtgttcgcggtcgccgtccgccaggcggtagatctcctcgggcatcaggcgcggcgacttcgcggtggcgtaccggttcccggcgacccgctcaaaccgcgtggagcggcgtccggcgatgccgcggcgggttgtgccctcggtggtggtctgcacggtgcgccggtagtacgtcgcggttgtcatgccccggcgggcgttgacgacctgctcaatgtccgcgccgtcgccgattgccttcaccgcggctgcgccgaacgccttgtgccgctgggcggcggtcatctgcccgaagacctggcgggcgctcgtcgttggcggggtgaagctgcgggtgaccggggccatggtgcagtcgcaccgcgggtgccgctggaacccagtgctcagggtgtactcgcggctggcgaggacgatgcaccgcgcgcacgcggggagctccaccacgcggacgtaggaggtgatggcagggcggacgatcatcccgatcaggtcggcggcccgcccggtgtccgcgatgaccgtgcggaccaggaggtcgagcagggcggctccgctcgcccacgcgaacgcgaccgacgcgccgcgggccagggcgccgagcgtcgcccacagcgggtacatcagcaggcccgccagtggccggccgtccggggcggtcccggccagggcctgcgggacgagctggtcggactcggcccggtccgggtcggtgccgaggagccgctgcaggtaggggtcggtggaggcggcggccgcggactgcgccccggtgacgatgagcaggagctcgggcagcagctgctgcc

SEQ ID NO: 4296 - DNA, 685 bp, Unknown
  Kingdom: Bacteria, Phylum: Actinobacteria, Class: Actinobacteria, Order: Streptomycetales, Family: Streptomycetaceae, Genus: Streptomyces
ccggcctcctccgcaccgcgatagatgtggtcgcgcccccactgccccagcggttccagcgcggcgttcagcgagaggcccagcggggtgagcgaatactccacgcgcggcggcacttccgcatagacctcgcggtgcacgatgccgtcgtcctccagctccttgagatgggagctgagcaccttctcggtcaccccggtcacggcgcggcgcagctcaccgaagcggcaggtccgttcgttcagcgcccacaggatgagcaccttccacttgccgccgatcacgtccatcgccgcgtcgatcccgcagacgaaagcccctggcctccgtacgatccgcatcgtccgccctccccacctggtcgctgaccgcgaggtaaccacccactccacagtgcgtacttgttgcccccggcgccttcggccagcctaatcggcatgtccgacaacacttctgcttccacccggcccacccctctcaccctcctcggcctcggcgcgatgggcgtcgcgctcgcccgtacctggctcgccgccggccaccccctgaccgtctggaaccgcagccccggccggagcgccgaactcgccgccgccgtcgcggccacccgcgcgccggcggcggaggcggtgtccgcgagcccgctcgtcgtcgcctgcctcctggacgacgcctcggtgcgcga

SEQ ID NO: 4297 - DNA, 1238 bp, Unknown
  Kingdom: Bacteria, Phylum: Actinobacteria, Class: Actinobacteria, Order: Streptomycetales, Family: Streptomycetaceae, Genus: Streptomyces
gcccgccccgtgctcctcgccttcctcctcgccgccgcggtggacctggccggcctcctcgccggggccgacaccgtccacctggtcgccaagccgctgctgatgccgctgctcgccgggtacgcggcactgcgtggcggaccccgactgctcgtcgcggccctgctgttcgggtggggtggcgacgtcttcctgctcgccgacgacgacctggcctttctcgtcggcatgggctccttcgccgtcggccatgtctgctacctgacgctgttcggccgtgaccgcgcccgtgcgccactggccacggggaccggatacgtcctcgtcctcgtcgtcttcctcgtgctgatctggccggatctcccggcggacctgcgcatcccgctgaccggctacagcctgctgctcaccgccatggcctggcgcgccggcgtgctcggcccgtacgcggcggccggcgggtcgctcttcctgctctcggacgccctcatcgccaccggcatcgcggaatggccgcaggcacccgcccccgacttctgggtgatgctcacctacatcgccgcgcaggccctgctgaccctcggggtgctcacggcggccccggccgggagaaccgggcgaaccggggcgtaccgtgaacggggtaccagcatctgagaccggcaaggaccccgaacgtatgcgcgccaccgtcatccacgccccccacgacatccgggtgcaggaggtgccggacccggggatccagcagtccaccgacgtggtgctcagggtcctgcgggcctgcatctgcggcagcgacctgtgggcctaccggggagagtcggcccggcggcccggtcagcgcatcggccacgagttcctcggcgtcgtcgaggaggtcggccccggagtgaacggcttcgtcgtcggcgatctggccgtcgccccgttcgtctggtccgacggcacctgcacctactgcgccgagggcctcaccacctcctgccccgagggtggcttctggggctcggtcggcccggacggcgcgcagtcggacggcggccagggcgaggccgtccgtgtcccccacgccgacggcaccctggtcaagctcccggccgccgccgcatccgacgaccgcctgctcaccgccctgctggcgctctccgacgtcctgggcaccggccaccacgccgccgtcggcgcgggcgtcgggccgggcggcaccgtcgcggtcgtcggtgacggcgacgtcg

SEQ ID NO: 4298 - DNA, 1721 bp, Unknown
  Kingdom: Bacteria, Phylum: Actinobacteria, Class: Actinobacteria, Order: Streptomycetales, Family: Streptomycetaceae, Genus: Streptomyces
aacgcggtcatcgcggcgggcgcgggcgtcggcgtcctccagtggctgacgtcccgccgcgatgaccgcgttgaccacggtgtgcgtgaaggcgaagtaggcggcgaacaggggaccccggcggcgcaggacgaaccggtggagggcggtgtccgcgagcagggtgacggccagcagggcggccggggcgagcagccagggcagggcgaccaggccgagcggcagggtcagcagggcgagcagggccgcgacgctggctccggcgcgggggccggtggcgatgccgccggggaggtcgccgcgtcggacgtacagcgggatgtgcagccgggtgcggtggaagaccttgcgcaccacgatccgccaggtgtcgtcgtggtcgtgccggccccggacggtggtggagctgtggacctcgtaactccggcagatccgggccgcgtagtcgccgtcctcggtgtgccgcagccgggggttgaaggggccgatctcggcgaagatccgggcgggcatggcgcagatcgcggtgtgcagggtgccgatgcggccctcggtctcggcgagccagtagaactggtggaggcagcggtactcctcgatcaggctgtcccggatgaggggttcggcgtcgtacgtgccgcagaccgcgccgatgcgggggtcggagtcgagcagggcgacggcgttggcgacggcgtcctgttccatcgcgacgtcggagtcgacgaacacgatgatctctccccgggcgtgggcggccccggtgttgcgggtggtggccaccccgctgttgacgccggtgctgatcacccggacgccgcaggcctcggcgacggcgaccgagtcgtcggtggagcagtcgtcgatcagcagcacctccagcggctcgtaggtctgggcgagcgcggcgcgcaggcagagctccagggcgcggccgtagttgtagttggggatgacgacggagacgaggggttgcttccggttcatggggcgccttcgggcggtcggagggtcatgcggacgagggcgggaggaggagggcgagggcgacgagcaccgcccacagcgccgcgttgacgagcgtggcgcggtcccggaagaggacgtggacggggttgcctccgccctcctcgacgaggaggagctggaggtagcgggcgaggccgaagacggcgcagggggcggagagcagggtgacgagggaggcgccggcggcgagggacgcgtcgtcgcgcaggtagagcacgtaactgacggcggtcagcacggcgaccaggacgacgaggtggtcgaggaaggcgagcgtgtaaccgcgcagggccgggcggtgggcgcggcccgccgccgtcatctcgtgccgccgtttgccgagcgccagcatcaggcagagcgagaagacgcacagcgccagccactcggacatccgggcgccgatgagcagcgccccctggacgagccgcagcacgaagccggtcgccacgatgaacgcgtccaccagcggtacgtgtttgagtccttgggagtaggcgaggctcagcgccaggtagagggcggtcggccaccactgccaggcgggcccggccaccgcccagccggtcagcgccagggcgagcgcaccggtcaggacgacggccgccagggtggagacctggccggaggcgatcgggcggtggcgtttgaccgggtgcagccggtcccgctcccggtcggcgaggtcgttg

SEQ ID NO: 4299 - DNA, 790 bp, Unknown
  Kingdom: Bacteria, Phylum: Actinobacteria, Class: Actinobacteria, Order: Streptomycetales, Family: Streptomycetaceae, Genus: Streptomyces
tcacggcgctcgccgagcccgggaacgccctcaccgggcacgtgcgcctccacgaccgcgtcggtgagggcgttcccgggctcggcgagcgccgtgacggcctccaccgggcggggcccggccagccggaccgtatagctgtgcgcgtccttcgtgatccggcccgaggcgcggtcggtgccgttccacccggcggacaccttcgccgccctgtccaggaacgggtccagcacgccctcgccgaccgtggcccggctcgccccgatctcctcgcgcagcggctccagggccagttgaatgcgccaggcggcggcgccgtcaccggcggcctgggcctggagcaggtccaccgcgagttccccggcccggccgtagcgggccagctgctccgtccagggccgcacctcgtcggtcagtcggccgtcggcgggggtcttcagccgctcgggggccccgcgcatcacggagaaggccgctcgcagctcgctcgccgccctgtcccggcgggaggcgtccgcgcgggagttccagaacgcgtcgaacaggggctggaggtaggcggactcctccgcgccgagcaccgagcccgcgctgttcccggccagcgccagcagcgcgtcccgggtgcccgcgtccccgcccgccagatcctcgaccgcagcccgccacgactcctccgggcggtatcccttcgggttccaggcgaagtcggcggcgctgctggccaatgcgatggagcaggcgtccgcctcgcggatcccgctgttcaccgccgccgacttcgcctgga

SEQ ID NO: 4300 - DNA, 2113 bp, Unknown
  Kingdom: Bacteria, Phylum: Actinobacteria, Class: Actinobacteria, Order: Streptomycetales, Family: Streptomycetaceae, Genus: Streptomyces
cccggagagcagggcgagcagacccccggttgccgaccgcgctccgggccgcgtgctcccgccgctcagtccggcagcaggttcccccgccgcgagagcaggaagcgcttgaaggcggcgaccggcggggtgtcggggtgtccgtccagccaggcgaccccgatctcgcgggccgcgcgcggtgcggtgaccgtcagttcgacgaccccggggcgggcgaccgcgggcggcggcagcagggccaccccgagcccggcggcgaccagtccgcgcagggtctccgcctcctccccctcgaaggcgacccggggcgtgaagcccgcctccgcgcagaggtcgtcggtgatccggcgcagcccgtaaccgggctccagagtgacgaacgtttcgtcggccgcctccgcgagacggatgcggcggcgggacgcgaggcgatggtcgtcggggaccaccagccgcagccgctgttcgtcgaggcggcgggcgaccaggtcgggggcgtcgggcacgggagaggtgaggcagaggtcgaggccgcccgcccgcagccgttcgatcatcgcctcgccgtagttctgcacgagctggaagcggaccctcgggtggtcgacccggaaggcgcggatcagggcgggcacggtctccgagcccatggtgtgcaggaagccgaaggagacccggcccgccgtcgggtcggcgtccgcccggaccgagtcggcggccttctccacctcggccagggcccgttccgccgagccgaggaaggtgcggcccgccggggtgagcgagacggtgcggcccctgcgggcgaacagggcgacgcccaggtccgtttcgagccggaccatggcccgcgagagcgtggactgcggcacgcccagttcgtgcgcggcacgggtcacatgctcgtgccgggcgaccgcctcgaagtacgcgaggcggggcgcgagtacggcccggatgtcttcttcgtaactactgggtgacagccgaggccctgagctgcgttcatgcgccatgggattgattatggcagtttcgtgcattggacgcatgaaacgtctccctctactttcgacgtatgcctcccgccagtaccggggcatccaccatcgccgtggatgcctctgccccgcagtcccccgtcaccaccaccgccgcgcccgccgccgccacccatgagcgtctggagcccggccgccccggctaccgccggatgagcttcgccctcttcgccgccggtgtcgcggccttcgcactcctctactccacccaggcgctgctgcccgccgtctccgcgtcgttcgacgcgagtgccgggcaggcgagctggacggtctcggcggcgaccggggcgctggccctgttcgtgctgccgctgagcgcgctctcggagcggttcgggcggcggcagatgatgacggcgtcgctggcgatcgcggtgctcgtcggactgctggtgcccttcgctccgtcgatgggcgcgctgatcgccctgcgcgccgtccagggtgcggcgctcgccgggcttccggcctccgcgatggcgtatctcgcggaggaggtgcgtcccaaggcgctgatcgccgcgatcgggctgttcgtcgcgggcaacagcatcggcggtatgagcgggcgcatcctcaccgggtgggtcgcccaggcctggggctggcgcgccgcgctcgcagcggtcgggctgctcgcgctggcgtgcgccgtcgccttccacttcctcatcccgaaggcccggaacttccgtcccggttcgctgaacccgaaggccctcgcgaagaccgtcgccacgcatctggccgacccgctgctggtccggctgtacgcgatcggcgcgctgttcatgacggtgttcggcgcggtctacacggtgatcggctaccggctggtcgaggagccgttcagcctgccgcagggcgtcatcggctcgatcttcctggtctacctggtcggtacggtctcctccgccgccgccggacgcctggtggcccgcctcggccgccggggcgcgctctatctggcggtctccaccacggcggccgggctgctgctctcgctggccgaccggctggccgccgtggtggagaccgccagatag

SEQ ID NO: 4301 - DNA, 590 bp, Unknown
  Kingdom: Bacteria, Phylum: Actinobacteria, Class: Actinobacteria, Order: Streptomycetales, Family: Streptomycetaceae, Genus: Streptomyces
gcgacatcaagcccgccaacatcctgatggaggcgaccggaacaggccgcccgcatctgcgcctctccgacttcggcatctcgatgcgcaagggtgaaccccggctgaccgagaccaactacgtggtcggtacgcccggttacttcgcgcccgagcagatgatgggtgccgaacccgacttccccgcggacctcttcgcggtcggtctggtcgcgctctacctcatccagggccagaagcccgactcccaggcgctggtggagcacttcgccgcgcacggcacaccgagcgccccccacggcatccccgagccgctgtggcaggttctcgccggtctgctccagccggacccgcacgcccggttccggaccgcgacgggcgcgcgcaaggccctgaccgcggcggtcgagatgctgcccgaacccggcccggacgacgagccggtggaggtgttcgaccagatcgggccgctgccggcgggattcggccccgacggtcccgtaaccacccctcagcagcccggtgggcccgcccccgcaaccacggccggaccggcgcagcaggccgtcgcggggtccggtgcggaggac

SEQ ID NO: 4302 - DNA, 1560 bp, Unknown
  Kingdom: Bacteria, Phylum: Actinobacteria, Class: Actinobacteria, Order: Streptomycetales, Family: Streptomycetaceae, Genus: Streptomyces
ggtggtggtggcggcggtttagtcggttgaacgtggggcgggcgggggtgaggatcagggtatggattatgtgatgcgtgcggtgcgggccgaggaatggccgcaggtcaagcagttgcggctggttgctttgaaggacccggcggccccggtggcgttccttgagtcgtacgaggagtccgtggcgaagccggacgtcttctggcaggagcgtgccgccgctgcggccgaggacgggggcggtcgtgtccggcagttcgtcgcggagtcgcccgagggggtgtgggtggggtcggtcaccgtgctcgtcgagagtccggaggacgatgtgcgcttcggggaggccgctgcggtggaccaggcgcacctggtcggtgtgttcgtccggcccgaggtccgggggaccggggtgacggacgcgttgttccgggaggccgtcgcgtgggcctggtcgctgtcctcaccccggctggagcgggtgcgcctctatgtgcacgagaagaacccgcgggccgccgccttctaccggcggttcgggttcgtcccctccgggcagcggattccggccccgggcggtcggggcgagctggagctggagtacgtcctcgggcgcgaggggtagcggcgggcgctccggaggctgtcgtcgtgcggccgccagggatgacgggacagctctcagccggcgcccggggccggagcgtgcaggcgttcctgccagcgggcccgtccctgctcctgggagcggagcagcaccagggcgggcatgccccggttctggccggttgccagcagctccgggagctgggggaggggtgccacggccgcgacgtcgtcgaggacgagcgtcattggtgggtcgagccgaccgtcggatgaccgtgcggccatgcggcggccgtgctcgaccacgtctgcggcgagcgcggtgaggaggggcatcgcgccggggcgggagcggggatcctcgatgggttcgcccaccagatagagcgttcccccttcgtccacaaaagattccagcgcgagggaatccgctcggttcgccgtgcaggcctcgcggatgtgcaccgtggacagtgcggcgaacgcccgtaccgtcagttcctgggccacttcgcgccgttcggggtaggcggtgagggcggactccagcaggccggcgagtccggacgcggccttggggtgcgtacggaggaggcgtaccggttcgtgggcgccggatccggaggcccagcggaggacctggcggaaggggcggccgtccaccgcggcggcgtgcagccagcactggaggagcgtctgcgccgtgtcggccaccgccgcgtcgatccgggcctgcgggcgtaccggggcgagcagggcggcggcacgtgcggcggcgatgtcggggagctcgcagcccgcggtgggcgaccagtggaggcgggccggggtgtcgcagaggtggcccgggtcgtagacgaggaccggaccgagcttggcgcgggcttctttcgtctcggcccagacggtggggtccgaggtgacgacgaggacggggccttcggcgtcgtggac

SEQ ID NO: 4303 - DNA, 640 bp, Unknown
  Kingdom: Bacteria, Phylum: Actinobacteria, Class: Actinobacteria, Order: Streptomycetales, Family: Streptomycetaceae, Genus: Streptomyces
gagccgtacgggcacgccggtccgggccaggcgtcgggcgacccggccgccgaccgctccggtcgctccggtcaccgcgatgagggggccgatcactggagttcgtcttcctctcgtcgtcctccgtcccagggccgcacctccacgaccgcgcccaccgggagcggtccgtacaggtgcgggaactcctcgccgccgggcttcatcgcctcgtaccggacggggtcggcgaggcgggcggggtcgacgaccaggaccacgaggtcccgggcgtcgtccccgtacagcatccgggccacaccggggagttggtggggcagcgagagatggatgaagccctcctcatggagggtgcggccgcgggtggacatctcgtacgtccctgtcccgcgggccgcctcccacaggggtgcttcggcgaggtggagcagcggttcggtcatcgaaccacgctaacgggcgctgcttcgtgcctgctagaaggtgcggcgacgagccctgcgcgtggccacgagaaccgtgccgccggcggcgaccagcgctgccgcgatggacccgatgatccattcaccgccccgggaaccggtgtcgggcagctcacccgggtggctcggcgagtgcgtggggtgcggcgtgtggc

SEQ ID NO: 4304 - DNA, 1254 bp, Unknown
  Kingdom: Bacteria, Phylum: Actinobacteria, Class: Actinobacteria, Order: Streptomycetales, Family: Streptomycetaceae, Genus: Streptomyces
ccgcgaccggccgcccggacccgcccggtgcggcggctcgggcgacgtgctcaccatggcggcccggatgatccgttcctgatcctggcggtccaccgtgtccatcgcgcgcaccttcgcctcgacgcgcgccagcccggtggggccgacgacgtctccggcggccaggtcgcggcccggccccggcaccgtacggccggtgccgctccacaactccgtggagcccggccgggtgccgaacaccggcacgtcgccgcaccacagctccgcgacctcctcgtcctccaggccgggcagcgcgggcacccccaggagcggggtgcgcagcagcgagagcacctggtgccgctcggtggcgtcccgcatcaggtcggggtgggtcgactcgtccagcagcgtcgtgtacgtccaggtcggccggggcacgacgcgcacttcgtcccgcgcgaagagccgcaacagcccctcgtcgccgaggagttccgatcggtgatcgctgatcgcggtgtaaccggcgcggaaaccgccgcacagcacgtcggtgtacgcggagggggccgccgccactccgcccagccggggccggttggcggactcggtgaaccggcccgcccgccgcaccagccgcatacggtcggttccggcctccgcccagtcggcggtctcgatcggcgacgacgcggcccggcccccgccgatggcggacatgtcgagcgcggtcgtgtccccgacgagcaactgcggcaggaggcccacccggtggaccgagtcgtggagggcccgggcggccggatcggtggacctcgcgggccccagcggcgggtggaacagggtctccacatcgaccaggaccggatgcgggccgcaggcgatcagattctcgtggtgcagatccgtaccgtccagggtgtgcagcagggccagcagcgcaccctggcgccggtagaactgccgggtctccgccgccgaggagcagggcccctcctcgacgaactcggcccagccgtagtccccccggtccaggacccgcaggacccgcagctccggggcgccgggcagcgaaccgaaccactcggccagggtgttgaagtgccggtgcgccgccagcggacgcggcttgtagaccagccgggcgccgtcggcgaaccgcagcagcatgaccgaccggcccccgcgatgactgtcgcccgccccggcctcgacgccggtgagcgccccgggccccgcgctgccgccgagcccgccctccggggt

SEQ ID NO: 4305 - DNA, 612 bp, Unknown
  Kingdom: Bacteria, Phylum: Actinobacteria, Class: Actinobacteria, Order: Streptomycetales, Family: Streptomycetaceae, Genus: Streptomyces
tcctcatcaccggcggccacaacacgggcggattcgcgcaggcccccgtgaccgcggaggcggtggccgccggtgatgaggagaagcccgcctccggcggtcctcgtggtctcgaaaaccggaaggctcgaagcggtccagggtcgcacgcaatatcttctgctccgctccagcaggcccgatctccgggcctcgtcgaatgcgtcggggaagaaggaggaggccgtgtcgtcgaccgccgcgtagagcgcttcgagctgcgtcggatcgaggttgtccgggtcggcgcccgtccagccgtagcccgatccgacggtgaggtaggagcggccgtccgccccctgggtgacggtgacgttggcgtcggccgccgtgtgcccgctcctggtgatcttcagggagttcttcagcccccggccgggatccgggagggtgagccaggcgccggccatgccgtggatcagcccggcggacgcggtgccgcgcagcagcgcttccccgtaggcaccgggggagaggacgtagtgatcggcgcggaccgtctcgccgtcgcggcatctgatcccgtccggcgcgccgccctcgcccgggacgagggcggcgcgccggacg

SEQ ID NO: 4306 - DNA, 1556 bp, Unknown
  Kingdom: Bacteria, Phylum: Actinobacteria, Class: Actinobacteria, Order: Streptomycetales, Family: Streptomycetaceae, Genus: Streptomyces
gcggtcccccgtgcgggcgaacccgcggacaccgcggccgtcgcccataccgcgcgggtcgtcgtcgagccgctggaggggccggccacgggcgtacggctgcgcgcgggggatccgcggccgtggctgcggggcccggctccgcgtctacgcgtcttctccggtgccgaccgccaggaggtgctggccgcactggaatccggtacggagtcctcggccgggcccgcccggctggcgttcgtggtcgacggtgacaccgcgccgcaggaccgcgccaaagccgcccaccactggctgacgcggggaggggtccgtccggccgacgtgttctaccgggacgggccggtcgcgggacagacggctttcgtgtacacgaacggctcggccgcgtacccgggaatgggccacgagctgatgctggcgtgtccgtcgctgggcgaaatcgtccgggagcagcaccgggcggtggggacacggctgcggtcccgggtggagccgggggtgctcggccagatctggtccgtcgccgaactcgccgtcctccacacggtgttcagccgcgagattctcgggctgcggcccgatgcggcgctcggatactcctcgggcgagtccacggcgctcgtcgcgctcggggcctggccggatgcctcgggactgtacgaggccacccgggacagcggcctgttcacgaccgaactcacgggtgagctgcgggcggtccgacgctcctggcggcagcggggcatccagggctcccggtggtcgagctacctggtcggggctcccctggaaaccgtccgcgcggagctcgccgcggaggccgcggtccatctgatggcggtgaacgcgcccggagtctgtgtcatcggcggcgagtcccgggcgtgcgccgcggtcgtcgccagaatcggggccgaccgcgcgatcgagctggactacgacatggcggcccacgcgccggagctggccgaggtggaggaggtctggcgggcgacccaccgccgtcacaccgtcgaggtgcccggggtgcggttctacagcggagcaaccgggcgggcgtaccggcccacggccgagcgggccgccgaggcgatcaccgcacagggcctcggcacgatcgatttcgctgccacggtcgagcaggcgtgggcggacggtgtccggatcttcgtggagcacggaccccggaggctgtgcaccggctggatcaaacgggtactcggtgaccgggagcatgtggctgtcgcgctggacgccccgggggacaccgggctgcggcacctgtgcctcgcactcggcgaactcgtcgtcgccggtgtgccggtggaggcagacgcgttgctcacccggctcgccgacgcctcgacggagctccctcgtcccggccccaccgtcacctttcgtgtacccccgtctccgtgcctaccgccgcccctggagcctgccgtgaccgttcttcctcgggcccccgagctgaccccggttccggatggtggcgccgtccgcgtcacctccccggccgttcgggagccaggtggccggtgccgctggtc

SEQ ID NO: 4307 - DNA, 1721 bp, Unknown
  Kingdom: Bacteria, Phylum: Actinobacteria, Class: Actinobacteria, Order: Streptomycetales, Family: Streptomycetaceae, Genus: Streptomyces
ctcgtccccggtgcgcgccttcgaggtcgcgcggcgcttcggcttgctctccgcctcggcgggggcctctgcggccttggaggaggccttgggggcggcggatccgccacccgcctgcgcctccttgatgacctcgatcagctggctcttgcgcatccgcgcagtgcccctgatgccgaggccggacgcgacctgctgcagctcggccaggaccatgccctcgaggccggtgccggagcggcggcgccgtgcggtggtgccagtggcagcaccttcggcgggcgcggcgctgtcgacgctcttgtcggcagtcacgcccatcagatcggtggtgtcgctcacgaagggtccttccctggagcggacgtcggccttctggctcggcgaccggttgtgctgtccgactgcggtctgttgatcttgttggatcgcggaccttgccggggcggtggtccgccgggtgtacggcggagagatgaacgtgcggggtccggcgcgagatccccctgctcggcccactcctggacgagcgaggggtgtcgtgccggttccggagcgtgctcgaaactgctcaggcaggctgctcaggcagttggggaggctcccggaagaatggtggtcccggagggggacacgaagcaacgcgcctcaaagacgtcggttgcagacttgaggttaacactaccggctccaacaaacattccccctctcgctcaccggtaatcacatgcggttacgcggccagcggcagcacgccggcgcccgtcgcgtcgagtgccagccggttcgccgcccagccctcacccgccagtcgggcgaccttgtcggccgagccttcctccgtcagcgcgaggaccgtgggccccgcgccggagatgaccgccggcacaccgtcggcgcgcaggcggttgaccagttccacgctctccggcatggcgggaccccggtattcctggtgaatccggtcctcggtcgcggcgagcagcagctcggggcggcgcgtcagggcctcgacgagcagggccgcccgaccggcgttgagagccgcgtcgacgtgcgggacggtgcgcgggagcaggccgcgcgccgtctcggtgagcaccggtcgcccgggtacgaagaccaccgggacgacggattccgcggggtccatcctgatcgcccgggccgcgccgccgtccatccaggcgagcgtgaagccaccgagcagacaggccgcgacgttgtcggggtgtccctcgatctcggtcgccagctccagcagggcggcgtcgtcgaggcgggcgtcgccgcccgtcgtcacggcgcgggcggcgacgattccggcgcagatggcggcggaggaggagccgaggccgcggccgtgcgggatgcggttggcgcagacgatctccagcccgcggggctggccgccgagcaggtcgaacgcggtgcgcagggagcgtacgagcaggtggctctcgtcgcggggcagcgtctcactgccctcacctgcgatgtcgacgtgcagcccggagtcggcgacccggacgacgacgtcgtcgtacagccccagcgagaggcccagggcgtcgaaacccggacccaggttggcgctggttgcggggacgcgcaccctgacggcggcggctcggaacgcgggaccggccatcggtcggaccactccttgtaaggcggcggggatgcagtgcgggtggctctgcggcggcggggctcatggg

SEQ ID NO: 4308 - DNA, 2998 bp, Unknown
  Kingdom: Bacteria, Phylum: Actinobacteria, Class: Actinobacteria, Order: Streptomycetales, Family: Streptomycetaceae, Genus: Streptomyces
ctcggcggcgccggccgccgagctgtggaggacgccgttcgatccggccgacccggtgcgcaccccgcgcggtctgaacacggccgcacccgtcctgggcagggccctggcggacgccgtggcggagctgcgggcggcgggcatcgcgctggacgcgccgctgggcgatcaccagttcgtcgtgcgcaacggcaagcggctccagatcggcggcgggacggagtcgctgggcatctggaacaagaccgaaccggtgtggaatgcggcgggaggcggctatacggaggtgtcgtcgggctccagctacatccaggcggtcggctgggacgacagccgctgcccggtggcccggacgctgctgacgtactcccagtcggagaacccgaagtctccgcactacagcgaccagacccggctgtacgcgggtgagcgctgggtgacgccccggttctgcgagagggacatcgcgcgctcgccggatctgcgggtggtgcgggtgcgcgaacggcggtagcgcggtgggcggctgggtccgccgctccgcggtgagaggggcgtccgcctcggcgggcgcccttctcgctgacgtgtcgtgaacatcctcgcgccgcgtcacgctccgccgagccgtctgccgcggaggcggcgggtggccgtcacgtagtgccgaaggaccgtgtccaccggtgggccgcgcgtcgtggctctcgggcggctccgtctcgctcaccgtcatccgcccgtactgccgtccggcggatgggacgagctggtgaacaccgcaccgggcccgcgagcggcggccgggccctctcggacccgttgctctacagcgggcgctcgcaaccctcccagtacggttcgcgcagccgtcgcttgtagagcttgccgttggggtcgcggggcatggcggtgatgaagtcgaggctccggggccgtttgtagccggcgagccgctcctcgcagtgggcgaggatcgcggcggcgagcgccggtgacggatcgtggcccccggccggttcgacgacggccttgacctcttcgccgcggtcggcgtgggggatgccgaaggcggcggcgtcggcgacggcggggtgggtgagcagggccgactcgatctcggcggggtagatgttcacgccgcccgcgatgatcatgtcgatcttgcggtcgcggaggaagaggtagccgtcctcgtccagcacgccgaggtcgccgacggtgaagaagtcgccgatgcggttcgtgcgggtcttggtctcgtccttgtggtagctgaagccgccggtgctcatcttcatgtagacggtgcccagttcgcccggcgggaggcggttgccgtcgtcgtcgaagacggccagttcgctgatcggccaggccttgccgacggtgcccggcttcttcagccagtcctcggcggtggcgaacgctcccccgccctcgctggccgcgtagtactcctcgacgcagctcccccaccagtcgatcatggcgcgtttgacgtggtcgggacagggagcggccccgtggatggcgtgccgcatggaggagacgtcgtagcgggccttcacctcgtcgggcagcgcgagcagccggtggaactgggtggggaccatgtgggtgtgcgtgcagcggtgggcgtcgacggcgcgcagcatctcctcgggcgaccagccgtccatcaggaccagcgggtggccgatgtgcagggcggcgcccgcgaattggagtacggcggtgtggtagagcggtgagcagaccaggtggacgttgtcgtcgaacggccggatgccgaagatgccgaggaacccgccgagataggtctcctcggggcgtttgccgggcagtgggcgcctgatgccgcgggggcggccggtggtgccggaggtgtagttcatgacccagccgagggtgcggtcctcgggcggggtggcggggtggccttcgaggagtccggcgtaggggcggcagccggggaccgtgccgacgccgtaacggtgggtcgcgggcagttccgcctcgtcggcggctgccgtcgcggtggccgcgaagcgttcgtgggcgatcaggacgcgggcgcccgagtcggcgacgatccaggcgatctcgggaccgacgaggtggtggttgaccgggacgaggtagaagccggcctgcgaggcggcgaggtaggcggtgaggagttcgacgccgttgggcagcacgacggcgaacgcgtcgccctcgcgcagtccggccgcgcgcagaccgtggaccatgcggttggcgtcggcgtggagccggccggcgctccactcctcgccgtcgggggcgatcaggacggtgcggtcggggtcggcggcggcctgggcccagaagccgttgggcggctggttcacgtggcgctccttccggcgatgcggttcatgcgggtgacggcgcgttcgaagccgcgggtcaggtcgtcgacgacggcccggacgctgcgttcgctggtcatccggccgacgatctgcccgacgggcgtgccgagcagttcgccgacctcgtacttctggatccgggagacggcctcggcgaccagcagcccctggagcggcatgggcagggcgccgggtccggccgcgtcgtcccaggcgtcggtccacgcggtacggagctggcgtgcgggtttccccgtgagggcgcgggagcggacggtgtcgccggaccccgcggccaggagtttggcggtcagggccggggagtgcaggtcggcctcctcggtggtgagccagagggagccgagccagacgccctgcgcgccgagagcgatcccggcggcggcctgttcaccgctgccgatgcctccggcggcgagcacgggcagcggggcgacggcctcgacgacttcggggaccagcaccatggagccgatctcgccggtgtggccgcctgcttcgtatccctgggcgacgaccacgtcgatgcccgcctcggcgtgccgccgggcgtgccgggcgctgccggccagcgcggc

SEQ ID NO: 4309 - DNA, 1490 bp, Unknown
  Kingdom: Bacteria, Phylum: Actinobacteria, Class: Actinobacteria, Order: Streptomycetales, Family: Streptomycetaceae, Genus: Streptomyces
gccgccggtgaacggtggcaggcccgcgtcgctgaccaggtcgcgcggggtgtggagggtctcgacggtggcgcgcagcgcgtccagcgggtcgccgcccgccggaacgcccacgggcggggtgccgagccagagggcctcgccgtcgcgggcggtgagggtggcgtcgctgcggaccccgatgaaggagtagcgcgaccaggtccggccgttctcggcggattccaggaggaaggtgccggtgcgttcggcggcgagcttgcggtacaggccgaccggggtgtcgccgtccgcgaggaggcggcggctgacggggacgacgcgccggtcgacggccagtttgcggaaggtgtcgagatccatggccggtgaccttactttccgagaggcagggcgtcggcgtcgaagcaggtgcggtcgccggtgtggcaggcggcgccggtctggtcgaccttgacgaggacggtgtcggcgtcgcagtccagggcgacggacttcacgtgctggacgtgaccggaggtgtcgcccttgacccagtacttctggcggctgcgcgaccagtaggtgcagcggcccgtggtgagcgtgcggtgcagcgcctcgtcgtccatccagccgagcatcagcacctcgccggtgtcgtactgctgggcgatggccgggtcgaggctgctggcgggcggcgtggcgccgggcgtgctcgtcatgggcccattgtgccgtggccacggaggctttccgggcggacgtccactgggcggaccaggggtgacggtcgtacgctggcggtcatgtcgacccatgcgaagcgtgaacgtcttctgctcgcggatctgttggaagcggccggtcccgaggccctgacgctctgcgacggctggaagacccgcgatctggccgcccatgtggtggtccgcgaacgccgcgcggacgcggcgggcgggctgctggtgagcgcgctgaaggcccggctggagcgggtgcaggcggagttcgcggcgaagccgtacgaggaactgatccagctgatccgcaccggtccgccccggttctccccgatgtccctcaagcagatcgacgaggcggcgaacaccgtcgagttcttcgtccacgcggaggacgtgcgccgggcccagcccgactggtcgcgccgcgagctggacccggtcttctccgacgtgctgtggtcgcgcaccgagcggacggcccgtctgctgggccgcaggtccccggtgggtctggtgctgcgccgcccggacggccggacggcggtggcccacaaggggatcccggtggtgacggtaaccggggagcccgccgagctcctgctgtacgcgttcggccggcaggacgcggcggacgtcgaggtggagggcgaccgggcggcggtggagcggctgcgggcggccgagctggggatgtaggcccggcggaggggcctcgggtcagcggggcagttcggcgcggcggagtgcggtgaaggtcaggcc

SEQ ID NO: 4310 - DNA, 831 bp, Unknown
  Kingdom: Bacteria, Phylum: Actinobacteria, Class: Actinobacteria, Order: Streptomycetales, Family: Streptomycetaceae, Genus: Streptomyces
tacgccagtgtaccgatacgtcggcgtatcggtacacacgcgtatcggtacactggcgtatcgagaacctcaccgcaccgccgcaggaggtacagcccatgtcgtcgcccgattccgcaccggagtcagccctcacgtcccgccgatcgaagatcacaccggagcgggcacaggagctttacgcggccgtgctggagctgttgcgggagagcggttatgagtcgctgacgatggagggcgtcgcctcgcgcactcggtgcgggaagtcgacgctgtaccggcagtggggctccaagccggagctggtcgtggccgcactgcacggcacccggcggatgcggctcccgaacatcgacaccgggacgctggccggggacctgctggaggccgcacggacgatcggcgaggcctccggcagcgacaccccgctgatgcacgccctcggccatgccgcgctccagagcccggagctgctgtgcgcgctgcgcgaggcgctgatcctgccggagatcgcggcgatcgacacgatggtccggcggggccaggagcgcggcgagatcgcggcggaccttccgggagccgagttcgtcgcggcccagctgctcggcgtgatgcgcgcccggccgctgctggagggtcgctacgccgacgcggcgtacctgacccggttcgtggagatggcgatcctcccgagcctcggactcacggcgggagcgccggagtcctgacagacgtggacggcccaccccagcggatggggggcggtccacccgcgccgcaccgtggggacgggggcggcgcaccgcccggccggccggtgacctctgcgga

SEQ ID NO: 4311 - DNA, 1051 bp, Unknown
  Kingdom: Bacteria, Phylum: Actinobacteria, Class: Actinobacteria, Order: Streptomycetales, Family: Streptomycetaceae, Genus: Streptomyces
acggactccccgcgcgccgcccttgacggccgcggcgcgcggggagtccgtaccggtggcgtgcacgccggggaagagttcggcctgcgtcgcgagcagcaccccggtctcgccgagcgcggggagcacctccgcgatgtagcgcaggaacgccgggttgggtcccacgatgagcacggcgcgcttggccagcagctctcggtgctcgtacaggaggaaggcggcccggtgcagcgcgacggcggtcttgccggtgccgggcccgccctcgacgacgaggacgccccggtgcggggcccggatgatgccgtcctgctcggcctggatggtccgcacgatgtcgcccatgcgtcccgtgcgtgcggaattgagcgccgcgagcagtacggcgtcgccgttcggatcctcgaacccggtgcggtcgcggtccccgagatcgagaatctcgtcatggagctcggtgaccgttcggccttcggtggtgatgtgccgccgtcggcgcagacccatcggcgtgtgccccgtggcgagatagaaaggacgcgccaccggcgcacgccagtcgatcagaacaggggtgtgctcggggtcgtcctcacggatcccgatacggccgatgtggtgcgcgagtccgtcggagcggtcgatgcggccgaaacacagtgagccgtccaccgcgttgagcgcggcgagcagtcccgagcgctccgcgacgaggatgtcgcgctccagccgcgcctgctggcccgtcccgaccggcgtcagcgcgtgctcgacgccatcggcggccaccccgcgcagggcgtcgacccgggcatggagccggtcgatgaattcctgctcttcccgcaattcgtcgctttcccggtttgacaaaacggctccccgccagatatattcgtactcataaggcccccgagcggggcctttctgcatgagcgcatgaagaatccaatatacccgcgacaatccccggaccgcaattacggtccggggattgttcgttcccggcggctatcggccgaatgcggctgcgcgcggcccctcgtcg

SEQ ID NO: 4312 - DNA, 1529 bp, Unknown
  Kingdom: Bacteria, Phylum: Actinobacteria, Class: Actinobacteria, Order: Streptomycetales, Family: Streptomycetaceae, Genus: Streptomyces
cggcggcgagatcggccacccggccgtcggccgactgcacggcggagaaggcgacgagggcggtcgaggcgcgcacggccgcggcgaggccgtcgagcggcgcgtaccgcatgcgcagatcgccgcggagcgcgaacggactgaccacggaggagaactcaccctcggggcagaggacttcggcgcccggcggcagcgaagcggcgatcagaccgacgtggacggtgacggaacttccggtggcgacccggtccggatggaccccggcgagccgggcgaagccggtccgggcggcctccaccgcgtcgaagctgcccgcgcccacccggcgccccgcggcgttctcgtcggccagggccttgacggcggcgatcgtccggcggggcagcagaccccagctggaggtgttgaggtaggtgacctcgggcgcgaattccacggctgccgctcggacgggcgcaaggatcgtcatacgtccaccctgaagcccccttcacccaaagtcaatcacggagagttaagggggcaccaaaggaatgcttatagtcggcttccgggcggcgctcagctccggggaacctcgcaggacccgtccgtgtcgcaggccgccgcgtccccgccgacggcggtgagagcggtgacgggacggtccttccaggcctgctccagcgcctggacgaaaacttccgacggctggccgccggagatcccgtaccgccggtcgagaacgaagaacggcacggcgttggcgcccagttcggccgcctcgcgctcgtcggcgcggacgtcgtccgcgtacgcctcggggtcggcgagcaccgcacgggcctcgtcggcgtcgagcccggcctccacggcgagggcgagcagcacctcgtcgtcgaagacggaccgctcctcggcgaagttcgcccggtaggcgagagtcagcagctcgtcctggcgaccgcgggccttggccaggtgcagcagccggtggaggtcgaaggtgttgccgtggtcacggccctcggtgcggtagccgagcccctcggcctgcgcgttggccgcgacgttggcctccatcgaggccgcttcctcgcggctgcgaccgtacttctcggccagcatgtcgatcacgagcgcggtgtcgcccttggctcgcgaggggtcgagctcgaaggagcggtgcaccacctcgacctcgtcccggtgggcgaactccgcgaggcccttctcgaagcgggccttgccgatgtagcaccacggacaagcgatgtcgctccagatctcgacgcgcatgactcttcttctctccaggggtcgcgacgggcacggagggtcctccgcacggggtcagtgggtcgaacgcgaatccggaccgggtgattcccggaccttcccgtccgcccctccttccctcccgcctcgcccccgtcgccgcctcgtcccccgtcaccgccgcgtccccctcaccgccgcgccggccttcaacgcccgtcgcgcaggttctccactcccccgggcaggaacgcgatgtggtcgaagac

SEQ ID NO: 4313 - DNA, 737 bp, Unknown
  Kingdom: Bacteria, Phylum: Actinobacteria, Class: Actinobacteria, Order: Streptomycetales, Family: Streptomycetaceae, Genus: Streptomyces
cgagggcggcatgggtcaggtcttcctcgcccgctccgaccgcgggcgcaccgtcgccctcaagctcgtccgccgcgagctggccgaacagcccgagttccgggcccgcttccgccaggaggtccgggccgcgcaccgggtcggcggcgcgtggaccgcaccggtgctggactccgacaccgaggcccccgtcccctgggtcgccaccggttacgtcgccgggccctcccttcagcgcatcgtctcgggccgccccggcgctccggtcacggactcgggggcgtacgggccgcttcccttgcgttccgtacggttcctcggctccgggctcgcccacgccctccagcacatccatggggccgggctcatccaccgggacctgaagccctccaatgtcctgatgaccatcgacggcccccgggtcatcgacttcggcatcgcgcgcgccctggaatccgtccccgacggcgacctgacccgtacgggcgccctggtcggctcgcccgggttcatggccccggagcaggtgcgcggcgagcgcgtgaccaccgcgtgcgacgtgttctgcctcgggtccgtcctcgcgtacgccgcgtcgggccgactgccgttcggtacgccggagagcggcggggtccatgccctgatgttccggatcgcccaggaggacccggacctgaccggggttccggaggacctggccggcgtcgtccgggactgtctggcgaaggacccgg

SEQ ID NO: 4314 - DNA, 736 bp, Unknown
  Kingdom: Bacteria, Phylum: Actinobacteria, Class: Actinobacteria, Order: Streptomycetales, Family: Streptomycetaceae, Genus: Streptomyces
tgctggccgacgcgggcctggtcgaggcccgcgtcgtccgcaaggccctgcgcgccgcctccgagggcgagccgcttcccctggacggcctggcggacctggcctccaccgaactgtggctgcgccgcctgctggcccggcgcggcacctgctggacgggtacggccgctccgcgccagcgcgcggtcgcgggcggtgtgatccccgcccggcgcacgctccagccctgaccggaaacatgctccgctcctgaccggaagaccatgcagggaagcccggcccgggacgcgtacggctcaggcgcagctgatccgggactccgcccagtcggccagggccaccccgccgaagggcgtctccggttccaccacgaggcggatcgaggactggccggcgatgttcacgctcaccgggacggcggggtcgccaccctccatcaccggggagcgccacagccgggccccgtccccgttgaacacggagaagcgcaccgcgccgagccccatggtcaggtcgtccacgccgaccatggcctgataactcgtgcacggccggttcagctggatggtcaccgaggagcgggcgtgcacggtcaccccgtgcgcgtaacgggtggaggcgatggacacgttcgaacgctgccagacccaactgctctgccccatcgcgacctccggctcgctcctgtcgccgaacacggagtacgccagctcgctgacctggtacacctctgggg

SEQ ID NO: 4315 - DNA, 1906 bp, Unknown
  Kingdom: Bacteria, Phylum: Actinobacteria, Class: Actinobacteria, Order: Streptomycetales, Family: Streptomycetaceae, Genus: Streptomyces
gttcgtccgccagccgtgacacgagatccgccgggctccagtgcggccgggacgccaggagcgccccggcgatgcgcagcgcgagcggcagccgcgcacacagccgtaccaggtcggacaggtccgccggggtggccggtgccggccgcccgcccatgctgccgcgcagcatggccccgaggccgcccagccgcacgcggccggtggcgatcacgccacacgtgccgctcgtcggcagcagaggagccaactgctcctcgttgtacgcgtcgtcgagcaccaccaggatccgccgctccgcgagcatgccccggtagagatccgtgcgctcctgcggatcgtccggcaccgcggcggcgggcacacccagcgcacggaggaaacggccgagcacggtggccggtgagacccgctgcgtccgtgcaccgtccagcgccgcgaacagctgaccgtcggggtaagcggacctcagccgatgcgaggcctgcaccgcgagggcggtcttgccgaccccgccggggcccgagatcgtcaccgtcgcggccggttcgtcggcggcgcggtgcgtacggagccgggcctcgatctccgccaactccgcccgctgcccgctgaagtcgccgagcgccggtggcagcatccgggcgccggtggcgttccgccggtcctgtcccccgtccgcgaccgtccggtccagcgcggggtcctcgccgaggacggcccgatgcaggtcccgcagcgtgtggccgggctccagaccggtctcctccgccaggaactcacggacctggaggtaggcctgcagcgcgtccgcccgtcggccgcagcgatacagcgcgagcatgagctgggcccacatccgctcgcggaacgggtgctccatcgtcagcgccgtcagctcgccgagaagctcgctgtgtcggccgagccggagatcgacgtcgatccgctcctcgatgacgccgagccgcagttcatcgaggcgagtggcctccgggcccagtgccgggaggtcggcgatcccggcgaacgcgggtccccgccagagctccagggcctcctcgaagagccggcgcgaccggtcgcggtcaccggccgccagcgccgtccgggccgcgcccgccaggtcctcgaagcgtgccgcgtccacctcggtacggtcggcccgcaggacgtatccccggccctcgcgggcgatgcgtcccgggtcgtccaggcgctgtcggagccggtggacgtaggtctgcacgttcttggcggcgctcttcggctgctcgccgccccagaccgcttccaccagcgcgtcgtcggagaccggccggcccgctcggctcagcaggaccgccaggagcaactgccctttcggcgtgcccagttcgagcggtgcgccgtcccgacgcacggtcagcggacccagtaccccgaagtccacagctccccccccgccttcgacggccactgtaacggccaccggccgcgcccggcccgacggagccgccgggcggtacgtgccgggccggcgtgggacggggtctgatgctccgggatccgcacccgccagtagagttcgatgcttgttcgattcgatgcgaggtggggggacggatggtgggcacacaactgagagacaccgcaaaggagttggcgggggtgttgtggcgggagcacaccgtgtaccgggagcggtccggggggatggtcatccggggcgagcacgtacggcggtggatcagcctcgctcctgcgggcggccgggacgagatcctcgtgcgcgcgggacgcatcctggacggcggcaccaccgctccggcgcgttcggaggccgtggtgcctctctccgccggtacgggtgtgctcgccgcgacctgccgacgcctgctggccgacgcggcgagcacacccgtac

SEQ ID NO: 4316 - DNA, 725 bp, Unknown
  Kingdom: Bacteria, Phylum: Actinobacteria, Class: Actinobacteria, Order: Streptomycetales, Family: Streptomycetaceae, Genus: Streptomyces
cttccgctcccagggccgggggcccggccctgggagcggaagtacatggggtcctggatgcggtccagcggtacgtcggcctcgggcaggcccagttcctcgccctggtagaggtagacggagccgggcagggcgagcgagagcagggcggcggcgcgggcgcgccgggtgcccagctccaggtcgctggggacgccgaacgccttggccgagaaggcgaagccggtgtcctcgcggccgtagcgggtgacggtgcgggtgacgtcgtggttgcagaggacccaggtggcgggggcgccgacgggggcgtgttcggcgagggtctcgtcgatggcgcggcgcaggagtgcgccgtcccaggggcagctgaggaaggtgaagttgaaggcggtgtgcagttcgtcggggcggaggtagcgggcgaagcgctccgagtcgggcagccacacctcgccgacgaagatgccgtcgaaggtgtcggcgatcgcccgccagccccggtagatgtcgtgcagctcgtcccggtcgatgtacgggtggggcccttcgtgcccgtcgaggtccgggagcgccgggtccttggcgacgagggcggcggagtcgatgcgcacgccggcgacgccgcgttcgaaccagaagcgcaggacgtcctcgtgctcctggcgtacggccgggtgtgcccagttcaggtcgggctgctcggtggcgaagaggtggaggtacca

SEQ ID NO: 4317 - DNA, 747 bp, Unknown
  Kingdom: Bacteria, Phylum: Actinobacteria, Class: Actinobacteria, Order: Streptomycetales, Family: Streptomycetaceae, Genus: Streptomyces
gcctcgggccggacgctgtccaccgatgcgaagcgtccgcagggaactccgcctcccgcacctggattcgggtacggatccggaacgggcgaaggcgacggcggtgacagcccgacgcagcagctcggcggtcagcagccgccgtcccgtcccggaggtggcacctgatggcgaccacacggcaaccccgggtgcggggccacgtgccccggcccggagccccggaccgggtgccgttcccggtggtcgacgaggtggcccggcactgtgcgcaggacgccgagccgaacacggtgcacatcgagatccatctgcccggacgggtggacgaggcgcggctgcgctccgctttcgccgaggcactcgaccggcacccccgggcgctgatgcgggagcgcccccggtccccgttggcccggcgctacgagtgggagctgaccgggagtcccgacgcggatccggtctccttcccgccgtccgcgcgcggggcgctcgaccgggcccgggcgcgggcgctggaggaggctccgccgctgacggcgtcaccgccgctgcggctcgccgtggtcgaggagccggggaccgaggggtgtgtgctgctcttcaccgtgcaccacaccgccctcgacggcccggcctgcatgcggctggcggcgacgaccgccgaggtgtacggcacgcagcccgtcccgccggcccccgcaccggcacggccggcgtccgagccgcccgccggggattctccgg

SEQ ID NO: 4318 - DNA, 1172 bp, Unknown
  Kingdom: Bacteria, Phylum: Actinobacteria, Class: Actinobacteria, Order: Streptomycetales, Family: Streptomycetaceae, Genus: Streptomyces
gacattgctgcgcacggcggccaccggtgcggaggcgaagtacgcgcccgacgcctcgaccagcaactgcccgtcggcgccgagactcgccagcaccgaccgggccccgcgctcacgcagttcctcggcggccttcagcgcgtcgcccaccgtggcgagcggccggccgacggcctcggcgagctcctgcgcattgggcttgatcacgtcgggcccccggtccagggcggcggtcagcgccgctccggaggtgtccagcgcgatccgcgcgccggcccggtggctccgctcgaccagctccgcgtaccactgcggcggcagtccgcgcggaaggcttccgcagcaggcgatccagtcggcggcggacgagcggacccgcaccgcttccaggacgtcctccgcctcggccggactcagctcgggtcccgccgcgttgaccttggtgagggtgccgtcgggttcgacgagcgtgacgttgatccgggtgttcccggcgatcggcacgccggcggcctcgatgcccaggtcgccgagcagccgggtgagcagggcgccctccgggccgcccatcggggcgacggcgacggtgcggtgtccggccgccgcgaccgcgcgggagacgttgacacccttgccgcccggatcgacgcggtccgccgtggcacgcagcacggtgccgcgggtcaggccgggcagctcataggtccggtccaggctggggttgggggtgacggtgaggatcatgcgcgtactacttccgtgccccggctctcgatggagcgggcgtcgtcggggccgaggcccgtgtcggtgatgagcaggtccacatcggtgagatcaccgaagcgggcgaagtgctcctgcccgaacttgccggagtcggcgagcaggacgacccggcgggccgccttgatcacggcccgtttcaccgcggcctcggcgaggtcgggggtggtcaggccgctgtcggtggagaagccgttggtggcgaggaagaccacgtcggcgttgatctcggcgtacgaacccagcgcccaggcgtcgaccgccgcgcgggtgcggtgccggacccggcctcccaccagatgcagcgcgatgccggggtggtcggcgagtcgggctgccaccggcagtgcgtgcgtcaccacggtcagcgtcgcgtcgaccggtac

SEQ ID NO: 4319 - DNA, 1297 bp, Unknown
  Kingdom: Bacteria, Phylum: Actinobacteria, Class: Actinobacteria, Order: Streptomycetales, Family: Streptomycetaceae, Genus: Streptomyces
ccggcctctatctgacctggctgggcttccgcgatgtcggccggcccggagccggccctgcctccgggatcgacctgcgggcggacgggctgatcgcgcgagtcgactccagcacccggccgacgacgctgcgcgcggtcgagaccctctggctcaacgcgctgggcgcatcggcgaccggggtcttcttctctctcgcgggatacgcgaccgatgcccgggaccgcgcggacggcgtcggactcccgctcttcgtcatggatctcaccgggagcccgcggcccgtgaacagcccggcggacgaactggtgagcacgggggcctgaacgtcgccgaacgcgagaagtcccccggggggctccgggaagcgcgtgccgggccatcggccggacatcctgatccggccaccacgtaccggaccgccgtccggcgcggcacactgagtacatgcgtatccgctccgccagacgctcggatctaccgcttctccaggagatcgagcgcgccgcaggggaaccgttccgggccctgggcatggccttcgtggccgacgacgatccgcccccgctcgacctgctggagagctaccggctcgcaggccgctgctgggtggccaccgaccccctctccgccaccggtgaccggccgctcggctatgtgctcgccgaccccgtcgacgacgccctgcacatcgagcaggtctcggtcgaccccgccgccgcccgccggggcatcggccgggacctgatcgcgcacctcgccgccctggccgcggcccggggcctgacggcactcaccctgaccaccttcaccgatgtgccgtggaacgccccgtactactcccgtatcggcttccgggtcctgaccgagcgcgaactcaccgacggactgcgcgcgatccgggccgaggaggcccagcacggcctcgaccgctggccccgggtctgcatgcggcgcgaactggcgtccaccgtccggccgtcgggtgctgcggagtccgtgaggattccccgcattccgaacgcttcggaggccccggacacttcggaagccattgctgtcagtggcagcccgtaagctgtgcgcatggctttactcccggacagctccctccccgcagaccaccccgctcccgccgccgagcaggccaacgaggccatccgcgccctcgtcgacgcctccggacaggactggtccgaggtggaggcggcgacgtacgaggtgctgctcatcgagtgggcggcggcgacccggggcgaccccgacatcatcgaagccgcctgacccgcccccggcc

SEQ ID NO: 4320 - DNA, 1622 bp, Unknown
  Kingdom: Bacteria, Phylum: Actinobacteria, Class: Actinobacteria, Order: Streptomycetales, Family: Streptomycetaceae, Genus: Streptomyces
ggtggcggcgggtccgcgggcgtccgcccgttccccggcgaggagcggacggagcatcccggtcgcgtcggccgagcaggactgcggcccggcctggacatgggcggtgcgcacctccaggcggtgcagtcgcaggtcctcccggtcgaagcggaagtgcagctcgcgccgcacggtgaacagggaggcgtcgtcgtcccggtggggcccgtccgccgggcgcagggcgtaggtgaacgtgtggtccgagaggacgtcgaggacgcccggggcctcctcctcgtagcggagggtgccctggacccggatctgcgggtccgcgagttccacctgctccgggtcgaagcgcaccagccagccggtggcggcttggctcccgtcgtccaccgggccgctcaggctccgttcgaactgcggacgctggtccggatcgaggaggtgctcgacgggccggcgtacggagccggtgaggacgtcgggattcagggacgactccaccaggtagtccttgaccgtggcgagagcggcggtgatctggctgtcggagaagttctgtgtgcgctccacggccgggtagttgatgcctgccgcgcccgtacggaatccggcgaccggctcggcccggtacagctgctcgggtgacccgcccggtacgacgccgcggggggccagggggacgacggtggtccgcaggggttcggcgcgtcgggtggccggttgggggtacgggctccggaatccgatgtagacggccaccgcgaaggccagggcgatgaggacgaccagggctatggcggcccgggagccgccgccgctccggatggagacctgctcgtcgggcagcgcacggacggcgcgggcgtgctcgcccatccgttcctgcgccgagtactcctgcatccgcgcagcctggacgaacgactcgtcgaagacgagcgagcggtactcgtcctcgccgcccgcggggttctcgggcgcgccgtccggtggttctgagcggcctgtcatgacttctctcccgatccccacaccgttcggttcggtgcgcaacggtctgcttcggccgagcggcgtccgcagcgagaagcccccctgggaacgaggggtcacatcttgagggtaggtcgattacggctcgcgtaaacgcggagacggccgggaactgcggggcgtccggggcggccgtcggcgaacgggtgacggaggggggtcagggaaccctgggctcggcggagaccgtggggcgggagtagtcggcggaggccgacggggcggccccgggcttgtccacgccgctggtgacgggcggcggcacctggtcctgccggttgttcgaagcgctccggtagaccgcggtgaaggcgagggagaccatgccgacgcccatcaccagggcgagcagccaggcgaccgggcggtgccagcgggcggagttccggtaggggcgcagggagccgccgtgccgcccgtacggcctcggggcgaagtcttcgtccccgatgccgtggtgcgggtcgtagtcgaggtcctgggggtcgtggtagtcccgggcgccgccgtaggggtcgtatgcgtcgtcgtcggcgcggcggcttcgacgggcacgcgcggcggcgagcagg

SEQ ID NO: 4321 - DNA, 1302 bp, Unknown
  Kingdom: Bacteria, Phylum: Actinobacteria, Class: Actinobacteria, Order: Streptomycetales, Family: Streptomycetaceae, Genus: Streptomyces
cccaccgccgctgcgcctccgcgagccgggtacgggcctggctgccgaccgcaccccggtgggtcgtgatgtagtcggccgccgccccgatcgcggaccgggcggtgagcatcgcctgatcgaggagggaccgggccttcgcctcgccccgctcctggtcccgggccaccgccagcgcctcgtccagggccgcgtccgcctcctccacccggcgcagcgcgtcgatcgggtcgtacggtcccgcggctgtcgcgccccgcacatcgccgagcacggcctccgcgccgggcgatccggccgcgcagatcggcggtcgacgctccctcggcggtcccttcgagcagcccgcccgcgtccgcgaggtcggtctccgtctcggtcagcgcggcgggcagcttccgcgcggcctcgcccagctccgccgcccgccggtccaccgagtccagcagcgtgcccgcctggcccaccgctccctcggctccccggatgtacaccgcggcccgggagttatcgccgccctcgaccgccgcacgggcctgccccacggccgaggccgcgaagacgagccggtccttcgcctgctcgacgtcggccgccacgggcgcggcggcgccctccccgtaccgctcgcgcagcccggcgacgcccgactcggccgccgcgacccgtccggcgaggtcgcggtgcgtggcgtccacggtggccagggcctccggcgcggtgcgttccagggcgcgcagccggtcgaagtccccggcgacggtgtccagaccctcgttcgcggtcgcgcaccgccgcaggatctcctccagcatccggcggcgggtcgcgtcgtcctcggggaaggcgtcgtcgagctgctgacgcaaccggaacgatcgcgtcagctcgtccttcgcccgcgcgaccgcctcggtgaagggcttcgccgcatcctcgccgaactgtgcggtggcgaagccgagttcctcctcgctggtgcgcaccgcgtcgtcggtgtccaccagcacctccttgacctgtccgtccagctccggcagcggtgtcggcggctccggcgcaccgcccgcctccgcaccccggccccagccggtggccgccggggtggtgcgggtcgtcgtgcgccgtttgcgacgggcgtacgcgtaggcgccgaccgctcccacgcccaccacgacggccgccggcaggatgaagtcgcgggcgccggtggagtcggagtcgcccgatccggggtcggcggcccccggggtgatggcgggggccgtcaccgggcgtccggccagcacggcgccgtaaccg

SEQ ID NO: 4322 - DNA, 595 bp, Unknown
  Kingdom: Bacteria, Phylum: Actinobacteria, Class: Actinobacteria, Order: Streptomycetales, Family: Streptomycetaceae, Genus: Streptomyces
ctgctcggcgccgacgggctgctgatcgccgagaccgcccccgtcgatgtggacgaacgggtccgggtccgtctcgacgacggccgggacgcaacggacggaaggaccgcccccgcctccgcgtgtgacgccgagccgttcccctgggcgcggatcgggacgccggccctgctgcggcacgcccgcgcgggtggctggcgtgcggccggtcagtggggcgcggagggacggaccttcgtctcgctgcgccggcccgtgcgggagcggaacgcccggaccagcagccagagcgcggaaagcgcgaacagcgcgccggtgatcagcagccagttgccgaagtagacgtccggggaggtgccggcggcggcctcgtaccgtcgttcggtccgccgggcgatcagtgggaaccagatcagcaggagcagcccggagaggaacgccggcacccggacgaagttcaccagggcctgccgggggccgagcgcggcgcgcagcgcccggtcggcccccgcgtacaccggcagcagcaccaggtcgtgcaggacggccgaccccgcgaaccagagcagtacgcccacggtgtccccgtccagca

SEQ ID NO: 4323 - DNA, 851 bp, Unknown
  Kingdom: Bacteria, Phylum: Actinobacteria, Class: Actinobacteria, Order: Streptomycetales, Family: Streptomycetaceae, Genus: Streptomyces
cccggccgcgacgccgcaggtggcgcggacctccgctccggtaggcacaccgacgaggcgtggggccgcgccgccacgcccgcgtacctcctcagtcgggcatggcggcgatcgcggccgcggcgatccttctggcgtccgcctcgcagcgtgccggagggtgttcgtcgccgccgaggtccacccgcaccgagagattgccgtcgaggacgttcagcgagcaggtggtctcggggtcttcggcgggattgtcgaggttgcgccagtaggccgcttcgccgaagccgagcgtcggctcgggcctgccctccttcgaacgcgtgtcgaagatctggcgctggaagaaggtcccgttgtcggtgggaccggaggaactgctcgaagacctcttgaggtcccactccacgaaggcgtgcggcgatgcgtcgcgttggctgacaccgccctcctcgtgacgtccgtaccaccagcaggcgttcgatgcccggtcgccggactcctggtagcggtccgaaccctcgtcccggccccgcagcggaaggctcttcgctgcctccggacagagcggcaccttcgtgtacgtgtccggccgcgcctcgacgcccttcgacggctcgccgtcgtcccccggaccggcggccgcggaatccccgtccccggcggcacccgacgaagagccggcccgccgatcggagggctcgccgcccccggacgtcagtgcgtacaccccgacaccgaccccggccagggcgagcacaccggccgccacgagcgccgcgatgacctgggtgcgtggccggcccgacggtggtgcgggagggacgggccgtaccgcggtccgcgtgggcgcc

SEQ ID NO: 4324 - DNA, 540 bp, Unknown
  Kingdom: Bacteria, Phylum: Actinobacteria, Class: Actinobacteria, Order: Streptomycetales, Family: Streptomycetaceae, Genus: Streptomyces
ccagacggccgggcacgacggcgatcgggggagctccggggtgtcggccggagccggatgtgccgctccaccggccggccggacacgcccccttttcacgcacccgccgacaaggacgcgacggcggattgtcaccggctgccaaagcccgggcaccggtgatccgatcggaaaccgggctcttcccaggcgtcgtcggcgtgcgtaccgtacccgtcggtagggaccgcaccccgtccggtcggcatacggccgagcccggtcgacgcaccaccgaagcccgaccgacgtccgttcgaagtccgctcgacgtccgcccgcaggggccgtcgccgagaagtggacccgctttccgcagccatccctgggcccacgcgcgccggaaggacacatccgtatgaccgtcgatgcacgcgccgcagcgagacgaccgatccactgggccgtgggcggggcgctcgtcgtcgccaccgcgctcgttcccggtgccgagtcggccgccgcggaacagacctcggaggtcgccctccgctacgcctg

SEQ ID NO: 4325 - DNA, 1155 bp, Unknown
  Kingdom: Bacteria, Phylum: Actinobacteria, Class: Actinobacteria, Order: Streptomycetales, Family: Streptomycetaceae, Genus: Streptomyces
ccgcaagcaccccgcacagggccagcaccagggccaggaacggcgcgtcggacaccgtgagccccacggcgatcagcgcacccagcgcgccggtcagctccaccggcaacgccaccgggttccgccgcagccgtgctccgagcagcaccgtcagcgcgggcaccagcagcaccagcggagcggcctcgtgcgggtcgaggtccagggaccggcccgcgaaccccgtgagcacggtgctccagaccaccgaggcgaccgcgaacaccgcacgcggcacgtcggcccccacccggaccgccgcaccggcgaacagcaccgccaaggtgccgaacaccgcgtaggaggccccctcggacgccagcgacagcagcccggcgctcaccgccccggccaccgccgccacgagcgcggtcaccggcaccgccgacgcgccccggccgctcccggcaccccggaccgccagcgcgagcagcccgcccgccagagccgtctccccggccaccgcgaccgcgtagggcacgtccagcacgaccccggccagcagcagcgcaccccagcccagagccaacgctcccgcaccggcggccccgcgcagatccgccccggaaagcctcctgcgggcaccggccccgccgacggtgtaccagagcgccccggcaccgggcggcgccgtccaggccgcgcccggcgtaccttccgtggtcgacgccgcgtccggcttcggcgtctcctcccgggcgcccgacgacgccgtgatccgcacgaccgagggccaccaccggtacgccgaccccagcagcccggccaccagggcgagcaccaccggggccgctgccagctccgaccacggcagcgtcgaccccagcgcggaccggaagccctccggggaccccgcccacacgtccgacagcagtgtcaccgggcccagcagcaccgacgcgagcgccggcagcgcccacacgagggcgccggccaccaccaccccggacgccgccagcaccccgcgtgccgcgtccctcggcagcccggcccgtacgaccccggtcagggcgaggccgcacagcagatacgcgagcacccgccagccgtccggcagcgcagcggccggtacgccgcccaccgcggccaccgccgcgaggcccgccaccacaccgc

SEQ ID NO: 4326 - DNA, 687 bp, Unknown
  Kingdom: Bacteria, Phylum: Actinobacteria, Class: Actinobacteria, Order: Streptomycetales, Family: Streptomycetaceae, Genus: Streptomyces
acggatcgtcgtcctcgggcggctggccgggcgtcggctggtcgttgctcatgggggcagtgcaccccgcaccaccggggcccgcaacggctcaggtacgttcgggggacgcggagcggcatacgagtctcaacgggcatgtctccccgcgccaggccacgcgtccctggggtccgctcagcccactgggccccctcggcgcgctcagcccgcgacgaaggtgcgggccgccttgtcgtgccagcactggcgccagggccggtcgatcaggcaccagagcacgttgaccacgccgatgacgagcagccccagcacgccgtagaccagccagcggcgcagggccgcgcccagggtgggcgcgtcgtgggactcgatgtcccgtacgtcgagtccgcagagcttcttgcccagcgtccggccccacttggccgtcggcagcgcctccaggaggaagccgatgaggaggaacgcggcgagcagcgcgcccagcagcgcaccggtggtggagtccagcagccagacggtgaccgtctccccggtctccttcgccgcggtgatcttccggtcgatgtggtcgagcgcccgggtcgccagcgggacggccgcggccccgaccgccgcgccgagcacgaggctgtcgaccagccgggcggcgaaccgcttgccgagtcccgcgggccgggccga

SEQ ID NO: 4327 - DNA, 650 bp, Unknown
  Kingdom: Bacteria, Phylum: Actinobacteria, Class: Actinobacteria, Order: Streptomycetales, Family: Streptomycetaceae, Genus: Streptomyces
ggccgcctccagggccgccgcgggctccccggtcatcagctgggtgaggccggagagataggccgcgccgagcatgccctcgtcgttccggtcgtagagggcgccggccgtgcacagcgcgccgtacttctccgcggtcgcgaagtcgccctggagcagggccgcgacgccgaggacccactgcaacctggtccggtggggtccgtcgacggggccggcgtccagggcacgccgggcgtagctccgggcctcggagaggtggccgcagcaggcccagaagaagccgacgcggcccgccatctcctgggccccctcgatgtcgtggacgagcaggtgctccagggcggcgcacaggtcgaggtgggtgtcggagaccttgtggtaccaggacacctggtccggtccggtccagccgtcgtgggcgcggcgggcgaggccgaggaagcttctcgcgtgccggtcggcggcggcgcgggcctcgcccagctcggtgagccacatccggccgtactcgcggagggtgtcgagcatccggtagcggtcgccgtcgcgctggacgacggactgggcgacgaggccctggagcgcccggtccacctcgtccggggtgagcggtccgcccgcgcagacctcgcgggcgacctcctcgt

SEQ ID NO: 4328 - DNA, 569 bp, Unknown
  Kingdom: Bacteria, Phylum: Actinobacteria, Class: Actinobacteria, Order: Streptomycetales, Family: Streptomycetaceae, Genus: Streptomyces
gtcgaaggcgtcatccggtccgagcggcgcccccgcgcctccgacggcgaggaccgcggcctgtccggccagtgcgcgcagggccagggcctcgacgaccggccggatcagccgggcggtcttcccggcgccgggtggcccgaccgcgagcagggaggtgcccagcagcgcgggatccagggcgaggcccgtaccccggcggacgtaggggttgtgcgggtcgtccgcgcaccggccgatcctgacctggccggtgagcacgtcgtggcgggctccgcgccggggcaggtcccggtggccggaagggtgcagggcggcggcgcctccggtccggagcacggcttccgcgaggggagcgagccggtcgggccgccgggtggcgagcgcccacgcgtggcgcagccgggccacgtccacatcgttcatccggccggtgcggacctcggcggtgagagtgtccgccgcgtcggtccagcccgcggtgcgcagctcgggccactggtcggcggaggtcgtggcggtgggggcgcccgcggcgccgtccggcggcggggcggcgccccggcggg

SEQ ID NO: 4329 - DNA, 1317 bp, Unknown
  Kingdom: Bacteria, Phylum: Actinobacteria, Class: Actinobacteria, Order: Streptomycetales, Family: Streptomycetaceae, Genus: Streptomyces
cgccgggttgacggtcaccccgtcgaggcttccgtcctcaaacgccggacgggctggatgtgctgccggaccggccgagaatcaagcccgtccggcgttcgaggacatccttgagcccgtccggagcccgtccggcgctgaggacaggacctggctcagctccgggccctgttccccgtgcccgtgcccttcagcgcgtccagcgcgtacacgcagcggtccttgctgcaggcgtagaccacgcctgcctgcgccacgggcgagcccgtgatctcgccgcccgtcgcgagcttccagcgcagttggccgcccgccgcgtccagcgtgtagaggacgtggtccgccgagccgaagtggacccggccgtccgccaccaccggagcgcccaccacgtcgccgcccgccgcgaagcgccacttcggggtgccggtgaccgcgtccagggtgtacagcgcgctgccgctgccgacatgcacgttgcccaccgcgaccagcaccggttcgatggaggagcgggcctccgtggcgatccgccagcggtccttgccggtcgtcgcgtccagcgcgtacaccgtgccgaggtagtccgcgaggtacaccccgccgccggtcaccgccgggcccggcgcgaacgcgggcggggagaggaagaccgcgggcgactcgaagtgccagcgcacccggccggagccggtctccaccgccagcacccgggtgcccgccgcgatgtagacgtagccgtcgggggccggggtgacccggaccgggacgccgccgcaggaggccgcgtcgccgatcgggtacgaccagcgctcgatgcccgtgcgggcgtccagcgcgcgcagccgggcgtcctgccagacgtacaccgtgccgtcgtggatgaccgggccggcctccgccgtctcgaagtcgctctgcgcgccggtgacttcccacagcttctcgccgttggacgcctcccagccctggacgccgccgccccgggtcgcggtcaggaccgtgccccggtcggccgtgagggcgtacacccaggcgtcggtcgacagtcgccactgctcggccccggtcgtggcgtccagcgcgtacagcgaggggccgtccgaggcgtggatcctgccgccctcgacggccatcgcccaggccacgtcccgggtcttgaactggcgccgcccgttgcccacgtccagcgcgtggacctcgaacgacgtcacgtacagcaggtcgccggagaccacgggcgtaccccacacgtcgttggacatgcggaagcgccagggtcgccagcggtccggcgcgggggccgcgccgtccggg

SEQ ID NO: 4330 - DNA, 1024 bp, Unknown
  Kingdom: Bacteria, Phylum: Actinobacteria, Class: Actinobacteria, Order: Streptomycetales, Family: Streptomycetaceae, Genus: Streptomyces
ggtggggccggggtcaggggtggaggccgctgaccaggtcggcggtggccccgacgctgtcgtggatggtcggcgccatgctcgtaccggccaggaagaaacccagcaggacacagaccagtgcatgggagaccttcagtccgccgttgcgcaggaagatcactgccaggatcagcatgagcaggaccactgagatcgaaacggccatggccaacctcctccgccgcgccggatttgcggcattcggccgccagtgtggcgcagcggaggggctgttcggcgcactggcgcgtccgccgaacgggtacttccggtccgtgaggcgttacggggtcgggccgccgttcccgcgagcgcggaggaatcgttcgagtccggccaggtcatcggtgttgagatggtcgaccccggcggcgagcagttcggaccagacggcctcacgtcggggcccgggcaggtccggcgtggcccagaagcggatacggcggccttcccggtgggcggtggcgacgagggtgcggagccggtcgctctcggcccggggaaaggggccggcgccgagccagccgaaactctgggtccagttggcgctgacgagcggggcgaacgaggcgggggccgcggtgccgaggtcgtcgaggcggccgtcgtagaacgcgtaccgggtgcgctgcgcctccatggggacgcgggcggcgcggtcaccggagatcaccggggtgaccgcgccggggtggacgcggccgtggctgtagcgggtgaggatccggtggtggcggcgcaactgccggtccagctcgcggtaggcggcgacgccgtcggccttgatgtcgatgaggagctgcagtgggacgcggcggtgcgggtggacgctgccgtgcccggcgcggaccagggcggcgagcgggtccaggtagagcgaggagagggtgcgggtggggtcgagcgtggcgggctcgtgagccacgagcaggtccccgtcgacgaggaagacgtccgcctcgacgctggtgaacccgtgggc

SEQ ID NO: 4331 - DNA, 522 bp, Unknown
  Kingdom: Bacteria, Phylum: Actinobacteria, Class: Actinobacteria, Order: Streptomycetales, Family: Streptomycetaceae, Genus: Streptomyces
cacgcgggagcgcaccgtgccgatcgggcagcctgcggcggctgccgcctcctcgtaggacgcgcccagcagttgggtgaggacgaaggcctggcggcgcgccgggtccagtcggcgcagggcgtccagcaccgcgacggactcctcgaatccggccggttgccggggctgggcgcgttccacggcggtctgccagtccgcggtgtcggcggtccgggggcgtacggcggcggcccggtgacggtcgatgacgacgcgtcgcgcgatcgacatcagccaggtccgggcgcaggaacgtcccgcgaaccgggccagtccgctcatcgcccggaggtaggtctcctgagccaggtcgtcggctcccggggcgtcggagctgagataggcgacgaatctgcggacgtcctcgtaggtcgcccggacgaagcggtcggcggcctcccggtccccgccgcccgcggcaagcgcccagtcggtgatctgcccgtcgttctgccgggcggccgggacccgggggtgggc

SEQ ID NO: 4332 - DNA, 1997 bp, Unknown
  Kingdom: Bacteria, Phylum: Actinobacteria, Class: Actinobacteria, Order: Streptomycetales, Family: Streptomycetaceae, Genus: Streptomyces
gcctggacctggtgccggatccccaccagccggtcgccgcccggcagccggagcagggcgaccagggcgtccgcgacgccgcgggccgtcaggtccgtccagcccaccaccccggcgacggtccggctgccgtgcgccaccgccagcatctccggggtctcctcggccgcggtcacggtctgcacgagcacggtggccgtcaccccggcggcttcggtctcggcccgcaggtcgtcctccgcgaaggtccggcgcagcggggcgagcgcgggaccggtgatccagtcctggtcgcgcacggagaggtcccacaggtgctggtgcgcgtcgacgaggaggggtccgctcacagctgccacaccaccggcaggcccgcgtcggcgcccgcgtcggagtagtcgtgcacgacctccaggaggtcggccatgcgggtctgccactccacgttgaccggcagctcctccagttcggccaggagccgcgcgtagtcctcgcagtcgagcaggtggaagaggtctgtgccgctgcgccagatcgtccaggacgtgcagccggcctcccgtatcgcccgggtcagttcgggcggcacctcgcggtgcgcctgctcgtacgcggcgacacggtccgcgcggacccgggtgtgcagggcgattctcaacggtctgctccaggggtgtcggtgacggtcaggatgacgtcgaggggcgggggaccggcgtcagggctcccccccgcccggggcaggtgacgtacagcgcgatcctcatcggccccgctcccggccggggaccgggacgtcgtcggacaggtggccctcgcgccgcaactcctcccacagggtggcggggatctcccggcccagcagggcgaccgcgtcctcggcctccgccgcgctgcgcagaccgagcaggaccccggccacggcgggatggcccagcgggaagcgggccgccacggctctcagcggcaccccgtgacgctcgcagatctcccgcagccggacggctcgccgcagcgtctccggcggcgccgccgcgtagtcgtaggtggcacccggccggggatcggccagcagacccgagttgaacaccccgccgacgacgaccgagacgccgcggcggagcgcggcgggcagcaacgcgtcgagaccgctccggtcgagcagggtgtagcggccggccagcaggaccacatcgacgtcggtctcggtgacgaagcgggtgggaaccgccgtctggttcatgcccacgccgatggccccgacgacaccctcggcgcgcaggcgttccagcgccgggtacgcctcgcgcagggcctggtgggtgtggtcgtccgggtcgtgcaggtacacgatgtcgacgcggtcgagcccgagccgctccagactcgcttcgaggctccgtacgatcccgtcagcgccgaagtcccacaccctgcggtacgcggcgggcaccgcgaagccgtgggcgaggtcgtccccgcgcgcgcccgggtcgggaacgaggagcctgccgaccttcgtggagacggtgtacgcgtcgcggggccggtcccggaggaacgcgccgagccgccgctcggacaggccgaggccgtagtgcggcgcggtgtcgaacgaccggacgccgccgtcccacgcggccgagagggccgcgtcggcctccgcgtcggtgacgctccggtagaggttgccgatccccgccgcgccgaacgcgagacgggtcgtccaggcggaaccccttccgagagggacgcgcccaaggccaggacccggggccgtgcccccggcgtgctccctccccgtgctcatgtccccgccgggcggagccggagcccggccatgccgccgtcgacggcgagagccgtacccgtcaccgatccggcggcgggggaggccaggtagacgacggccgccgcgacctcctcggcgctcaccagccgcccggtgggctggcgggcgctgagcgccgcgcgttcggccgccgggtcgtcggccg

SEQ ID NO: 4333 - DNA, 2664 bp, Unknown
  Kingdom: Bacteria, Phylum: Actinobacteria, Class: Actinobacteria, Order: Streptomycetales, Family: Streptomycetaceae, Genus: Streptomyces
gcggccgccgcgctggcgccgccgccctggctgtagccgtacagcccggtgcgggaggccgcggtgaccgaggcgccgggtacggagcgcgcggcacgggccgcgtccagcagggcgtgtccctggtcgaggcggttgacgtaggtgtgcaggcgatccgtggcgccgaggccgacgtagtcggtgacgacgacggccgccccggtggccaggatccggtagacggccagggcttcgtagcccacggacacggtgtctccgttgagggtgagcgggtgctccagggcgaaggacggggcgcactggtcgccctggcccatggtccccgaggcgagcgcgaccagggggcgcgggcctgtccccctccatgccgcggagggttcgatgtaggccccggtcacggcgacgggggttcccgccgagtcggtggacctgtacatgagacgggtcgcggtacccggcatcgggcggccgtcgaggccggggatgttcagcccgaggggcagtgcctcgctgcggatcagcgcaccgttctcggcgggcagtgcggtcggaggcgtgtagaactccgggatggtgacgccccgggagacgaccggcggggtcccggccgcggacgccgggacggccgacaggcccgcgcaggcggttccggcggcgacggtgcatgccaggaggcgcaggcgggccgagggacggcggcggccggtgcgtgccggccctgcggcgacgtccggacccggggaggcggcggaacgggaacgggttctcgtgcggctcacggtgggctcctcgtttctcgtgcggatgtggggatgcgcggatggccgcgggggcgacggaccgcgtgggcgtagacgtcgggtgcggcggcctctgggtgggggcagcctggcgtgggccgggtggagacggagcctcgccgtgctgatgcccgcgcccctccatgcggcatcgcacgccaagtgctgctgggagcagcactgttactcgctggtcacttccggcagcgtaggtctgcgtgtcactcagtgacaagatgtctgcatgcgtcattcctgtcgcggggtcgctatgctgccgggacacgactgaggccgggggcgaaggtgcgtgaactgtcgtccgcggaaggcgggcccagggcgagggacaccgccacgccgtcgctcacccagcgacgcagggccgccctccgcatggagatcgccgctgaggcggtccgcctgttcacctcgcagggtgtcgccggcaccacgggcgagcagatcgcccgggccgtgggtgtctcgtcccgcacactgtggcgccacttccccaccaaggagagctgcgtcctgcccctgctttctgcggggctcgaggtggccgtggaccaactgaccgcatggccgcccgggatgacgctgctggacttcgtgacgcggtccagcaggagtggcacactgccccccgcggctccggccgtcctcgacctgatccggatgacatccaccgaccccgcgctccgcgccgtctggctccaggcccacgacgacgccctgccggtcctcgcggaactcctcgcccggcgatccggcggcagcgccgatgccctcgggacgaaggtgcacgcggcgacgctcaacggtgcgctgcgcgcggcggcggaggaattcgcccaccggtacgccgacgatcccgaggcggcgggcgaggagatcgtgccctgtgtcctggccgccctgcaagccgcctcggagggcttgccgtactgaccgggtcgcggcccggccgcgaccctcacggccgggctcccccaccgccgagcccggataagacccccttacgatcggcgaccacggcagacgacatacggaggacacgatgggcggtcaggtcaccgcggtgagccgcagcgagcggtacgcgttcagcaaacccacccacccgtccatcaccctgctcgccggactcggcgtggagggggacgtgcatgcgggaaagacgatccgccaccagttccgcatgacgtacgaaccggacctgcccaacctgcgccaggtccacctgatgcacgaggaactcttcgaggagctcgcactcaagggcttcgacgtgtcggcgggccagctcggcgagaacatcacgaccgcgggagtcgaccttctcggcctctccgccggaactctgctgcgcctgggcgaggaagcggtgctggaggtgaccgggctgcgcaatccctgcgcgaagatcaacgacttccgccaaggactcctgggcgaggtcttcgccctggaccccgtgtccggcgagttcaccttcaagtcgggcgtcatggccgtggtccgcaccggtgggacggtccgcgccggcgacacaatcgagatcgaactgccgcctctcccccaccgggccctggagcgcgtctagacaacccgtcccgggaaggcggagctacccggccatggcgcccgggcggcaacaccggattgtcctcggcggccgctgccccggcgcgttcgaggagccggcaccggggcagtgctcccgcccgtcctcacccctgccgctccaaggagtccgcgaacgcgcgcaacgcatcggccaggtccttcttcgtcggcagctcatcgaccttcttctccaggtcgtcgatccgctgggcgacctccgcgaggtcga

SEQ ID NO: 4334 - DNA, 543 bp, Unknown
  Kingdom: Bacteria, Phylum: Actinobacteria, Class: Actinobacteria, Order: Streptomycetales, Family: Streptomycetaceae, Genus: Streptomyces
gaccggaccggacgcggacgacgatgctgtcccgaacgcgaccgctgcggcgggatcgctcagccgtcccagtccaccgtcaccacgatcttgccgcgggtccgcccctcctggttgagccggtacgcgtcggcggcctgctccagcgggaacacccggtccacatggacgctgacgatgccccgttcggccagttccgcgacctgggccaggtcgtcggcgtcggggcgcacgaaggcgtaacggccgccgtaggagaagacctcgccgtccgcgatggaggcgagccggccgcccggggcgagggtgtcggcggaggcgcggagcgcgtcgccgcccaccgtgtcgaaggaggcgtcgaagccgtccgggaccagttcgcgcagccggtcgacgaggccttcgccgtactccacgggctccgcgccgaggctgcggaggtgctcgtggttgcgggggctcgcggtgccgatcacccggcagccggtgtgccgggcgatctggacggcgatcgatccgacgccgccggccgccgcgtggacc

SEQ ID NO: 4335 - DNA, 839 bp, Unknown
  Kingdom: Bacteria, Phylum: Actinobacteria, Class: Actinobacteria, Order: Streptomycetales, Family: Streptomycetaceae, Genus: Streptomyces
caaccccttcggtccgggcgacgacgcagcctgcatcgccggactcaccgcgcagcgcccccggcccggccggcccggcatgcgctcccggctcgccgaggtcgtctccgccctcgtcgcccggaccgaaggggttgtggcggagcatcacgtcgagccccgtgacgggtgtgccctcggggtcgtcgactgcgagccaggcgggatcccggacgatgtcgaagccggggtgttcccgctgccagcgctcggcgagcccggtcgacaggaggcggtggacctcgacgccccggtgcagctccttgcggaggttctcccggcgggagttggtgatgcgtacgccgagggagagcttgagcatcacccgtgctccgggccggtgcacggtgcggatggaggaggtggggtgccagtgctcgccgtgcgggccgaggtcgtggagcagtccggtctcggcgagggcccggacctgggggcggtggagcagatcggaggcctgccaggggtgcacgggcacggcgacggtgccgggaggcaggccgatgccttcggcgtgcggggcgagcagctcctcggcggtggccggacccccctcggtccaggcggagtcggtggcgatcagcgaccggtcgacggcgaaccagtggagcgggaaggacccgtggagctccggggagtagcggcgggactccgactcggagaggccttcgcggctcttgggcgtggggtggagggggtggccgagcagcagggactgttcggcggtgaggaagaggtcggcctcggcggggtccgccgggttgcgccgccgctggtcgatgaagccggcggtgtggcgt

SEQ ID NO: 4336 - DNA, 846 bp, Unknown
  Kingdom: Bacteria, Phylum: Actinobacteria, Class: Actinobacteria, Order: Streptomycetales, Family: Streptomycetaceae, Genus: Streptomyces
gcccggcgatggcggcgacctcctcctcggcggcggtcagccccgcgaggatgccggaggcgtgccgtaccagcgcttcgccggcctgggtgaggcgcatctcgcgtccggtgcggatcagcagcgtggtgccggcggaggactccagggccttcatctgctggctgacggcgggctgggtgcagccgagttcacgggcggcggcggagaacgagccggtggtggacacggcgcgcaggacacggaggtggcgagcttcgatcaccccgccatcataagaaattcttggggaccgggcgaattcacgacgggagcctttgggattgggtgcggctagcgtgaccccatgaagctgctgaccgtgaacatcgggcaacctcgcccctccgcgcagaccggcggcccgggtggcgtcaccgggatcgacaagcgaccggtggagggtcccgtcgaggtcctcgaccccgggcccaagggcgaaggcggcagcggactggccggggacgcggtgtgcgacctgcgtcatcacggcggcagcgaccaggcggtgtacgccttcgcgcgggaggagctggacgcctgggagcgggagctgggcggccggaagctggccaacggggcgttcggcgagaacttcacgaccctcggcctcgacgtcagcggcgcgcggatcggcgaacgctggcgggtgggcacggacctcgtgctggaggtgacctcaggtcgcatcccgtgccggaccttcgcccaccatctcggggaggaggggtgggtccggcggttcacccggcaagccgccacgggcgcgtatctgcgggtgatcgaaccgggggccgtccgcgccgg

SEQ ID NO: 4337 - DNA, 937 bp, Unknown
  Kingdom: Bacteria, Phylum: Actinobacteria, Class: Actinobacteria, Order: Streptomycetales, Family: Streptomycetaceae, Genus: Streptomyces
ggacggcaccgcgcggcagggggcccgggagcccggcggcagggcggcgctggacgaggcgctggcggagatcgacgcgctggccgccctcgaccacgtacgcggggtcggcgagacgggcctggacttcttccgcaccggacccgagggcgtcgccgcccaggaggagtccttccgggcccacatcgagatcgccaagcggcacggcaaggccctggtcatccacgaccgcgacgcgcacgaggacgtcctgcgtgtcctgctcgacgcgggcgctcccgagcggaccgtgttccactgctactccggcgacgccgacatggcccggatctgcgcgcgggccgggtatttcatgtccttcgcgggcaacgtgaccttcaagaacgcccagccgctgcgggacgccctggccgtcgccccggccgagctggtcctcgtcgagacggacgcccccttcctgacccccgccccgtaccgaggacggcccaacgcgccgtacctcattccggtcacgctccgcgccatggccgaggtgaagggcctggacgaggacgtgctcgccgccgcgatctacgacaacaccgcgcgcgcgttcgatttctgacgccgaccgggcttggcgtgggcacgctgcgtagagacggtcccgtacgccgtcgaacggagcgaggaccccgagctgttccggggtgccgaggtcgtcgagagggccggccgcaacggggtgcgccgggtcacgtacgcggtccggaccgtctacggagtccggcagaaaccgcgcaggaccgccgaggaactggtccacccgccggtgagccgcgtcgtgcggaccggcacccggcagcgcaccgcaccggccgccggggcggacgggccgaactggtccgcgctcgccgcctgcgagtccggcggccgtcccggcgcggtggacccgagc

SEQ ID NO: 4338 - DNA, 670 bp, Unknown
  Kingdom: Bacteria, Phylum: Actinobacteria, Class: Actinobacteria, Order: Streptomycetales, Family: Streptomycetaceae, Genus: Streptomyces
ggcggcgaggagaagcaggaagagacgaccacctcgctggcggtcgccgaccccagcacggtcaagccggtcgccgcgaacaaccggctggacagccagctggagcagctctccgaaggcagcgacgacttccgtgagcgcgcgagccgcacgcaggagcgcatcgacctgcgggagcggcaggcggcggagaagaagaagcgcgaggaggaggccgcacgccgtgaggcgctgcgacccaagttcgtcctgccggtcaagcagcacgggctcagcgcctactacggtcaggcgggcgtcaactggatgtccgtgcacacgggcatcgacttccccgtctcgtacggcaccccggtgatggccgcgaccgacggcaccgtgcgcacccagctgaacagcgcctacggggtcatggcgatcgtgaccgccgccgacggcaccgagacctggtactgccacctcagcagcaccaagatccgctcgggcccagtgaaggccggtgacgtcatcgcgtactccgggaattcgggcaactccaccggtccgcacctgcacttcgaggtccggcccggcggcggctcggcgatcgacccgctggcgtggctgcgcagcaagggcgtcgaccccagctgagaccgaatcacgggaacggacggacggaagcgggaga

SEQ ID NO: 4339 - DNA, 672 bp, Unknown
  Kingdom: Bacteria, Phylum: Actinobacteria, Class: Actinobacteria, Order: Streptomycetales, Family: Streptomycetaceae, Genus: Streptomyces
cggcaaggcaccccgcaccgcccccgacccggaccggcccgaggacctgtggaaggccctggaccgcggcgaggacccgacgcgcgaggcgtgaccccacgctcacctcccgaggccccgtacgggacaatggacctgagccgtcccccgggcggcggccacacgtacagcgtcacccacagcgcaacaccaacgaggagcaactcatggcgggcagcagccacggacacaccccggccgcctggaccggtgtcatcattgctttcatcggcttctgcgtcgcaggcgtcttcatggtcgcggccaacccgctcggcttctgggccggtatcgccgtcatcttcgccggcggtctcgtgggcctcgccatgaaggtggccggtctcggcatgccgaaggagtcggccgagctgatcgaggccagggagcgcgccggtcgggcgcagatctcccactgacccggccgccggcccttcccggcgaccgacacgtcgacaggcgcagccccaccgggctgcgccttttcgcgtcggcgggggacaatcaacgggtggacgcctcgcctacccccgccgcagcccagcccccggacccggaaacagctcctcaccagggcctcggccccgacccggccgacccggaagccgcaccgcggggcgtcggcccctggaa

SEQ ID NO: 4340 - DNA, 872 bp, Unknown
  Kingdom: Bacteria, Phylum: Actinobacteria, Class: Actinobacteria, Order: Streptomycetales, Family: Streptomycetaceae, Genus: Streptomyces
acgggtacgcacccgcctgcacgggggagtcgccaggaggtacgggccgggtgcggggggcgttcagggccgcgcgggacttcttcgccggaggcggccccaggaggcctccggcactccggcggaggtttctaccgctcttcggagggttcggccgcgttgcgccagacggtgaggtcgaggctgacgtacgcactcggatcgccgctgcccgaaacgcctcggtagaccgccacggcgatgtgcccggcatcgctgaggacgcagatccgcgacccggacgtgagctggtcgagcgggatctcctcggtgtagcgggtcgccgaccgacaggtctccagggagcccttctgcccgttgctcagcaggatcagcttgccgttgcgggtgcgcagttcgtcgctgtccacgacgttgagcgtcttcggctggaagtgcaggtccgcatcactgctggagaggccgttcccgctctcgtttggacgcggcgggttgtccgccagcatcacgaagtggttctcggggatgtcgatgcctttgtacgacaccggcgcgggatccttctgcccctggccgccgccgttcccggtaccgctcccgttgccgctgctcgcactgctgccgggcgacgggtccttgtcgtcctgaccggagaagttccgcagcagggagccgaggactccgagaacgacgaccgcgcccacgaccgaagcggcgacgatcagcccggtccgccgggacttgtcccgctggggggagacggcgggcgggagatggacggcggcgggcgacgggccgtacgaacccgacggggacatggggtacgcgggcgggccgggtggtggcggcactgctccgggtgcggccggtcc

SEQ ID NO: 4341 - DNA, 803 bp, Unknown
  Kingdom: Bacteria, Phylum: Actinobacteria, Class: Actinobacteria, Order: Streptomycetales, Family: Streptomycetaceae, Genus: Streptomyces
ggcgccgaggtggaggtgggagccggtgccaccaccgtccgctccaccggccggctgcgcggcctcaccgtcaacatgcgcgacatctccgacaccatgccgaccctcgccgccatcgccccgtacgcggacggacccgtgcggatcgaggacgtcgccaacacccgggtcaaggagtgcgaccgactggaggcgtgcgcccagaacctgcgcgccatgggtatcaccgtccacaccggccccgactggatcgagatccaccccggcacaccgaagcccaccgagatcgccacccacggcgaccaccggatcgtgatgtccttcgcggtcgccggactgcgcacccccggtctcacgtacgacgaccccggctgcgtacgcaagacgttcccggggttccacgaagcgttcgcggacttcacgcgcgacctcacggcggggtgacgcaccacctcacggcaccgtgacgcaccaccgcgcggcacggtgaaccgggatctcgaagagcgcggacggaagccgccaacgcgccccaccgggacgcgctgtccccgcacacagccggagcggcaacaatggggggcatgagcgacagccccgcccccctcgccgatccgcatctcgtcttcgacgccgcggacggccgccgggatctcgtgatcctcggctccaccgggtccatcggcacccaggccatcgacctggtcctccgcaaccccgaccgcttccgggtcacggcgctctcggccgccggaggccgggtcgccctgctggccgagcaggcccgccggctgcgggtcgac

SEQ ID NO: 4342 - DNA, 919 bp, Unknown
  Kingdom: Bacteria, Phylum: Actinobacteria, Class: Actinobacteria, Order: Streptomycetales, Family: Streptomycetaceae, Genus: Streptomyces
agaagggggcgacgttcaccgctcgccgccgcggcccgtcgcgcgcagcgcctcgcggagcgcggcgacttcctcgtccgtcatccgctccacgaagtgcacgagcgcggccgaccggtcgcggctcgctcccagggcgtcctccatcagggcggcggagtaggcctcgcggctgcggaccggcgtgtagagccacgcctgcccctgcttccgccgggtcagccagcccttgttgtagaggatggtggccacggtcatcaccgtcgtgtaggcggccgggcggcggaggttgatgtcgtcgaccacctcacggaccgtcgccggcctgtcccacttccacaggcagtccatgatttcggcttcgagctctccgagccgtcgcattccccgtccctcaattccgtgcgccttcgcgcgcccgggaagcatagttgggttcatgctccgccacccgccgacggccgcgagggaccgcggcggctccacgtccgccccctccggctccggcccggacacccgggtgatccggtacgagccgaccgggaggccggcggcggggcgctaccacccccgccgggactcccgcaccagcagcaccaggagatacgccccgccgacgcacacggtgaccgcgccggtcggctcgtaccggatcacccgggtgtccgggccggagccggagggggcggacgtggagccgccgcggtccctcgcggccgtcggcgggtggcggagcatgaacccaactatgcttcccgggcgcgcgaaggcgcacggaattgagggacggggaatgcgacggctcggagagctcgaagccgaaatcatggactgcctgtggaagtgggacaggccggcgacggtccgtgaggtggtcgacgacatcaacctccgccgcccggccgcctacacgacggtg

SEQ ID NO: 4343 - DNA, 674 bp, Unknown
  Kingdom: Bacteria, Phylum: Actinobacteria, Class: Actinobacteria, Order: Streptomycetales, Family: Streptomycetaceae, Genus: Streptomyces
cggcccggccgggccgggcggcggccggggggagctggcccttcagcggaccccactcgttcgggtcggggaccccgggcgggagcatcgcacgacgcttgggaccggtgtggccctccgccggctcccccggttccttcgccccgggccaggccttggcgacgcgcgcggccaggacgaagtccttgcgcagcgggtggccctcgaagccctccggcaggagcagcggtacgaggtgggggtggccgtcgaacacgacgccgaacatctcgtgggtctcgcgctcgtgccacgcggcgcccgcgtagacgtcgatggcactgggcaggaccgccgcgtcgtgcggcacggtcgtgcggaccatcagccgccgcaccgtccccgtacccagggccgcgacatgggcgcagacgcggaagcccgtgcccggttcgtccacggcgctgagccagtcgaagtagctgcactcgagtgcgtcgcgggcggtccgcagcgcggtgagccaggaggcggcggggacgtcgacggtcagcaggtcgtacgcggactccgccgtggcctcgtcgccgaacaggtcggtgaccgcgtccggcagccggtcgtaggcctcggccgcggaacccgtgtgctggtggctgtcgctcatcgccgctcctccgtcggggccggcggcg

SEQ ID NO: 4344 - DNA, 1167 bp, Unknown
  Kingdom: Bacteria, Phylum: Actinobacteria, Class: Actinobacteria, Order: Streptomycetales, Family: Streptomycetaceae, Genus: Streptomyces
gctcccgccaccgctcccgccaccgctcccgctcccgtccttctcggcgtccgccgtcccgcccagctgcgcgccgccgcgcccgtcgtcctcgacctccaccgtcagccgcttccgcacggtcacgccggtcaccgtcacgcggctcgccccgctgtgcttcgccacgttcgtcagcgcctcgctgaccgcgaagtagaccgcggtctccacggcctcgggcagccggcccggtacggccatgagcacctcgaccgggaccggcgagcggtccgccagatcctcgacggcggcctccagaccccggtccgtgaggatgtgggggtggatcccgtggatcagctcgcggatctccaccagggcgaccgacgcttcctcgtgcgcccggtccagcagcccgcccagcggttcggcgggtcgctccagccgggcgaggcccagcgtcatggagagggccacgagccgctgctgcgccccgtcgtgcaggtcgcgctcgatacggcggcgttccgcctcgaacgcgtccaccagccgcgtccgcgaccggttcagctccgcgatccgggagtcgagcgcggagtccggcggggagagcagcgcccgggtcagtacggcccggccccgggccaccattcccagcggccaggtcagcaacggcagcagcaccacccccgccagcaggaccgcgaacgcctccggccaggagtcggcgagccagagcttcaggacgcgcgcctccccgtccccgcccgccgccatcatcaccggggtcccgatgagcccgccgcacaccagcagtacgctgccgacggccagcgcctccagcggccacaggacgaacgcgaagagcagcgcgtacgccagctcccgccaggtgcaccgctcctggagccgggtccgcagccaggacgtcaggcccggctcgggcggttcgcggtgcgggtcgaggaggggcgccgggtcgatcagccggagcctgcgccgctccagcgcggccagcggaaccccggcgaggacgagcgtcagcagcagcggcaccccgatgacgaggacggtcagcgcgctgcccacgacagccagcaggaggagcgccaccagcgtcgcgacgccgaggggcacgctggtcaggaggtagagcgcggcacgccacggccggccgccgaggag

SEQ ID NO: 4345 - DNA, 1562 bp, Unknown
  Kingdom: Bacteria, Phylum: Actinobacteria, Class: Actinobacteria, Order: Streptomycetales, Family: Streptomycetaceae, Genus: Streptomyces
gagaggagggcggcgtccgcgtcgaggcagaccagtacgtcggctgccgggggtccggccagcgccagggcggcggcggcgtggcccgtgtccagcagcagcagcggccaggcgcggtggccgtagtgcgcgacggtgcgggacgcggccacggtgaggacgacgagtacgcccggcgacacgccgtggggggccggtccgcgccggtgggcacggtgggcgcgcgggtcgtaggcgtaacgtccgggcggcagcgaacaccccggcccgatcaggaggtgggcgcgcaccgggtgcagggctcccgccgaggggacagggcgcagccggcccggtgtaccggcgggcgcggccagcgagagccgcaggacgcggtccaggtcgatcgcggcccggtcccctggatccgaacccgctccggaccggaactctcccccggccaacggaagtccggtcccgctccaggggaacgggcgctcgggaacgtacggggcgaggcccggcgcgcgcgaggagcggacgtctgcgagggcccggcgcaggaggccgggcgcggcgcgcgtcccggaatcggacgcgacggtccgggccgaggtgtcggacatggcggcgcgctccttcacatgtgcgggggcggtgcgagggtgaagtccccgggtgcggcgggcggtcgggctcgccagccccgggcgagcgcggcgtccgcgaatcgcgggcagccgaagtagccgaaggccgcgggcgcgttgggaatcagcccggagaccagtacgcgggcgacgcgcagagacgtctcggcgatgtcctccgtggtgaggtccgcggtgatcacgcggtggtccccggcgacgagcgccgcgtcgagcgcggtgcggctgccggggtcgatcgcggtgaccgggaccgtgccgagggcgggctcggtgaagcggcgggccagcggggccatccggtcgtccagccagacctggacatgagccccgaggtcccggacggcggcgaactcggacccgcagtcgtcgagatagcgccggtcggcgcggtggtcgaggtagaggccacgggcgagcatcccggcttcgaccgctcggtacacccaaccgtcggcgtccaccgcgccctgggtgaacacccaggtgtgcacggcctccagcacggccttgcgggccgcctccgccgggtcgtagcggcaggcgaacccggccgcgtatatgccgcgcacgggatcgtgcgcgagggccgccacacagggggagaactcggagggcatctccacgatgtgcacgtccagcccgcagcccgccaggtcctcggtgagcccggggacgctcgcagggtcgatgccccgggtgggcccgtccaggtgccaccacagctccagggcgtcgcgctcgacccatctcaactggcgtcagggggacctgcgttcgctgccccgcacccaccacctcaactacgcgggcatcgccaccgggcaggggttcgacgacgccgtcgagcgcggcctcctcgaagtcgtcgagcgcgacgccctggagctgtggtggcacctggacgggccc

SEQ ID NO: 4346 - DNA, 964 bp, Unknown
  Kingdom: Bacteria, Phylum: Actinobacteria, Class: Actinobacteria, Order: Streptomycetales, Family: Streptomycetaceae, Genus: Streptomyces
aacgagatcctggcggcgggagccgacgtcctggcgcgggccatcgtgaaggcggtgcgcgcggcccggagcaccgaggggccgggcggcaggctcctctcgtacacggagctgtacggcggctaagggccgtcccagccgtacggcgaccggcgcgacggaaccgtggagcggcctgcgccacggagccacacggcggcggcgggcgcccgatccgaacggcagatcccagggggcgcgcagcgtgagcgaagggcgcgcgggcagccgactcgtcgcccaggtaagggagttcatcccaaccgcccgaaatgcgccgggaacacgcggggaactttctgcgtgcgccctacgtttttaccaaccccggtcacgatgtcaggcccagggactacgttaagcacgcaccaagtaacacgcggcgacggcctggagacaccaccttgagcgatccgtacgagacaaccgagcaccacctcgaccgactcctgcgacgcgccctcaactccttcgaccttcccgacagcacggtcgaccgcctcggcaccgcgctcgctcacagcagttcgctgcactcgtcgcaccacagttccgtgctgcaccgcgagacctaccgtcacacgtatctcctctccgacggctccgccctcaccctgtgggagctggtgcacagcggaggccgggacgtgcggataccgcgccggcacgagctgtacgacgacgagggcgacgcccgcatcgccgcgtcccggctcgccgggagcttctccgactccccggccttcggcgacgagggggtgcaggaggcccagggcgatctggagatgctgacggtcctgatgtccgctcctccggccccgctcccccgcacgtacgcccccgacaattccgcggaccacgcccgccgggtgctgcgccgcgcggagaacgccgaccggccgggcgagcagaaggcccggctgct

SEQ ID NO: 4347 - DNA, 769 bp, Unknown
  Kingdom: Bacteria, Phylum: Actinobacteria, Class: Actinobacteria, Order: Streptomycetales, Family: Streptomycetaceae, Genus: Streptomyces
agggtggacttgccggcgccgttggccccggtgatggcgacccggtccgcccagtcgatctggagcgaggcggggccgaaggagaagtcaccccgcaccacacgggcgtcgcgcagtgtcgcgacgacggatccggagcgcggggcggaggcgatctccatgcgcagctcccactccttgcgcggctcctcgacggcgtcgagacgttcgatcatgcgctgggtctgccgtgccttcgcggcctgcttctcgctggcctcgctgcgggcgttgcggccgagtttgtcgccgtccgtggccttgcggcgggcgttcttgacgcccttgtccatccaggagcgctgcatatggccgcgtgcttcgagggacgccttcttgtcggcgtactcctcataaccctcgcgggcgtgccggcgagcggtctcccgctcctccaggtaggccgcgtagccaccgccgtagagattgatctgctgctgcgcgaggtccagctccagcaccttggtgaccgtgcgcatcaggaactcgcggtcgtggctgatgacgacggtgcccgcgcgcaggccggacacgaagcgctccaggcgctccagtccgtcgaggtcgaggtcgttggtgggctcgtcgagcaggaagacgtcgtagcgggagaggagcagcgaggcgagtcccgcgcgggccgcctgtcccccggagagcgcggtcatgggccggtcgaggcccacggtcaggcccagctcggcggcgacctgctcggcccgctcctcca

SEQ ID NO: 4348 - DNA, 822 bp, Unknown
  Kingdom: Bacteria, Phylum: Actinobacteria, Class: Actinobacteria, Order: Streptomycetales, Family: Streptomycetaceae, Genus: Streptomyces
ggcccggcgggtcctggacgagctggaccaggcgcggcacgagctggcgcagctggccgggctctcgggcggcagactgcgggtggggacgttcaccacggccgggatccatctgctgccgccggtcctgagcgcgttccggcgggcccatccggaggtcgagctggccgtcgcggactacgaaccgccggccgggatcgccgcggtcgtcgcgggtgaggtggacctcgccctgacccacgcctacgaaccggcggtggccggtcccccgccggtgggcgtgctcgtcgaacccctgctggtcgaggaactggtgctggtcacctcggtgggccaccggctctccgagggcaccgggcgactgccggtcggcgagctggcggggcggccgctgatcagcagcgcgcccacccatccgccccggcgcggggtcgagaacgcgctcgccgacgccggggcgacgcccgcggtggtctgtgagtcgcccgggtacgcgctggtgtgcgcgctggtcagcgcgggtctcggcgtggcggtggtgccggagatggtcgcgtcgatggcggctgccccgctttcggtccggcggctggagcccgcgtcgttccgccggaccatctcggtcgtgcaccggggcgaccggtcgaccgcagccgccgcgacgctgctcgcgctgctgcgcggcggattcggccgcgggagcacgaccccggcggcgaaccggcccccggtgggctgatctgccgccggcagatcagcccacgggtaccgacaggaccggcttcggagccgcggtcagccctggacgggaacgacccaggg

SEQ ID NO: 4349 - DNA, 1047 bp, Unknown
  Kingdom: Bacteria, Phylum: Actinobacteria, Class: Actinobacteria, Order: Streptomycetales, Family: Streptomycetaceae, Genus: Streptomyces
tgcgggacgtcccgcacagcgtcgcgctgcaccacgatctgtcgaccgccaccgacgggacggtccgccgctccctgcgggacaccggcggcgagctggcttccggcgaggcgccactggtgaacgcatgcgcctgctgcgcgctgcgcgaggatctcgtccccgaactcgaacgcctcgcggaggacggacggacccgcctcgccgtcctggagctctgggactccgtcgagccgaagtcgatggccgaggtgatcgccgcgcacaccaccgccgccgaggtcaccaacgtgttcgcggccgtcgaccccacgctcgccctgccctgcctctccaacggagacgatctggccgaggccggcctcgcggcggcgccggccgaccggcggaccatcggcgacacgtgggcccggcaggtggagtacgcgcccgttctggccatggcaccgagcccggcggccgacgacgaggaccgcgcactgatccggcagctgaacccgacggcccgccaggccgcttccggatcggttgagttggcccggctcgccttcgcgggattcgacgtcgaggcggcggacgcgagccagcacccggcctgcgcgctgcttccgcaggaggcggacgaggccggagtgggcacgctcgtctggcgacggcaccgacccttccaccccgagcgcctgctcgacgcgctggaggacctgagctgcgcggcggcccgcagccggggccggttctggctcgcggaccggcccgacaccctgctctcctgggatgccgcgggcggcgcgctctgcgtggaggacgccggcccctggctcgcctcgctcccggacgccgcctggtccatgatgccgccctaccggcgggctgccgccgcgctggactggcacccggagcacggcgactgctgccagcacctggtcttcgtctcccccggcctcgaccgcgacggcctgaccggcctgctggactcctgcctgctcacggacgaggagtacggctccggtcgggagacgtggaagagcctgcccgccgcgttcgacg

SEQ ID NO: 4350 - DNA, 1356 bp, Unknown
  Kingdom: Bacteria, Phylum: Actinobacteria, Class: Actinobacteria, Order: Streptomycetales, Family: Streptomycetaceae, Genus: Streptomyces
cggcggcgccggtccgttggacggatcagccgcggtcggcggcggagcctccgcggctctggctgccgggtccgtcgtagtcctcgccgtaggcgcccttggacgggcggcggcggcgcagcggcggctcgacgccgtccgcgaggcggcgggcggtgaccaggaagccggtgtggccgatcatccggtggtcgggacggacggcgaggccctccacgtgccagttgcggatcatcgactcccagggctgcggttcggcgaagcagccgatctcacggatggactcgacggtgcgcgagagctgggtggtggtggccacgtaggcgcagaggatgccgccgggcaccagggccttggagacggcctccaggcactcccagggggcgagcatgtccagcacgacgcggtcgacgtcggtgtcggagaggttgtcctggaggtcgccgacggtcagctgccaggccgggtgcggggagccgaagtagcgctcgacgttctgctgggcgatctcggcgaagtcctcgcggcgctcgtaggagtgcagcatgccctgctcgccgatggcacgcagcaggaaggtgctgagcgagccggatccgaccccggcctccacgacgcgggcgccggggaagatgtcggcgaaggccaggatctggcccgcgtccttggggtagaccacggcggcgccgcggggcatggacaggacgtagtcggggagcagggggcgcagcgcgagataggcgacgtttcccgtggtgcggacaacactgccctcgggagcaccgatcagctcgtcgtgcgggaaagaacccttgtgggtgtggaagttctttccggcttcgagcgtgaaggtgtagtggcggcccttggggtcggtgagctgtacctggtccccgaccttgaagggcccacgtcggcgggcggcaccggtcggttcagacatgtgaccagcctaccggtgattccggggcctccgaccgcccggccggtgcggtgacgggaccgcggccggggcctcaggcgccggggcgggccatggccttgacgaaggcgcgctccacgtcggcggtggagaggaccccgtagatctcgccggtctcctcgacgaccaggtattcggtcgcgggggtggccttgagccggtccaggagggcttcgccggccagttccgcggggatcctcatgccgtcggtgaggtcctgggcgaggccgctgacggcgacccaggggcgacggtgttcggggacgccgacgatggcggcctcgcggacgacgcccttggggttcccctgtccgtcgacgacgaccagggcgcgggcgcccgcctcgttggcccggcgcagcgcttcggagagc

SEQ ID NO: 4351 - DNA, 1406 bp, Unknown
  Kingdom: Bacteria, Phylum: Actinobacteria, Class: Actinobacteria, Order: Streptomycetales, Family: Streptomycetaceae, Genus: Streptomyces
cctcggcgacggcctcggccggctcctcggcgtcggcgaccttctcggtctcggcggaggtctggacctcggcggcagccgcggtctcgtccttcttgtcgccctcgagcaggtcgcgctcccactcggcgaggggctcgccggcggccttctcgcccggcttcgagtcaccggtggcggcaccggaacgggcgatgaggccctcggcgacggcgtcggcgatcacgcgggtgagcagggtgacggagcggatcgcgtcgtcgttgcccggaatcttgtagtcgacctcgtcggggtcgcagttggtgtcgaggatcgcgacgaccgggatgtggagcttgcgcgcctcaccgacggcgatgtgctccttcttggtgtcgacgatccagacggcgctgggcaccttctgcatctcgcggataccaccgagggtcttctccagcttggccttctcgcgcgagaggaccaggagctccttcttggtgaggccggaggcggccacgtcctcgaagtcgatgagctcaagctccttcagacgctgaaggcgcttgtagacggtggagaagttggtgagcatgccaccgagccaacgctggttgacgtacggcatgccgacgcgcgtcgcctgctcggcgatggcctcctgggcctgcttcttcgtacccacgaacatgatggagccgccgtgggcgacggtctccttgacgaactcgtaggcgcggtcgatgtacgacagcgactggagcaggtcgatgatgtagatgccgttgcgctcggtgaagatgaagcgcttcatcttcgggttccagcgacgggtctggtgaccgaagtggacgccgctttccagcagctcccgcatcgtgacgacggccatggccgtactccttgaggtgctcggttatcgcgaccgcaggtttgcggtcgcgcctgacgccccgacgcgccgtgccacgagggaccgaggagcgcggccacctccgagaagagggaggtggcggggcgtgcgaagtcgacccggtgacccggatcgccgtaagaagtgtacgggacccgccaggtgcctgatgacggcgatgtccacaaccgggtgacggcgacgtccacggccgggtggccgcgatatccacaaccggcgagtagtccacaggaacggtccgcgatccccggaatgccggcctccgggccatcgtggcggcatgcgccatcagcccggcccacgccgtttccccgcccgccgacccccgctcctgctgctcttcgtgttcttgctgtacgtgctgctcccggccggccctccacccccgggcgggtccgccgtgccggccggggctccggcgtcctcgccgggtgcgggcgccggcacggacagcggcgcggaaggcggcacggtcggtgccgcggacagc

SEQ ID NO: 4352 - DNA, 596 bp, Unknown
  Kingdom: Bacteria, Phylum: Actinobacteria, Class: Actinobacteria, Order: Streptomycetales, Family: Streptomycetaceae, Genus: Streptomyces
gccgcgacggctgccgcacccccctgccctgggcgtccggcgaaccgttcgccgggttcggctccaccgtggaaccctggctccccctccccgccgactggccggcccgcgcggccgacctccaggcacaggacctccactccatgctggccctctaccgtgaggcactgcgacagcggcgcaccctgaccgcactgcacaccgaaccgctgcgctggctgagcgaagaacccggcctcctgatgttcgcccgcggcgagcacctggtctgcgccgtcaacctcgccgagggacctgcccggctccccgcccactccgaggtcctgctcaccagcggccccctggacgccgaaggcgggctgccccgggacacggcggtgtggctggccctctgaaacggcacggcgcaccgaccggaggagtcccggcagcccgggagagccccggtgcgggggtgatcgaccagggagcctgagtacccgcactcaggccccgcacctcgcccgccgcgacgatgagggcgtggcgggtgaagccgggacaggcggaccccgcacgcaccgccgtcaccaggacggcctcgcccgccgaacccc

SEQ ID NO: 4353 - DNA, 1125 bp, Unknown
  Kingdom: Bacteria, Phylum: Actinobacteria, Class: Actinobacteria, Order: Streptomycetales, Family: Streptomycetaceae, Genus: Streptomyces
ccgtcggactctccggggacgcaggctccctcgtggggacacaggccgacctctcggtcctgccgctctcggtgaccctggtgggcgcactcctgatcgcccggggattcctccgcccgctccaccaccgggccgtcgccggaggccgcgaactggccggccgggcgggccgcgtcgccgccctgtgggtcatcgcgctgatcgtgctctcgctgatcgcccggcacaccttcaccctttcggtcgacgacctcaccgacagcgggaccggggacctcctcggcgactccccgaagatcggattccgggcggagatcccgctcaccctggtcttcgggctgctgtggctggccggcgtcctcgcgctggccctgctcgtctcacgcaaggctccgctcccggcccggctgctgcgcttccaggaagcggtgcgccccgcggcgtacgccatggtggcgctgctcctcgcgtgcgtcgcgctcggcgtggtcgccggactcgtcgtgatgatcacgcgcgggcaccccgccgagaccgccgcggtactcctcctcggactgcccaacctggtctggctcgcgctcaccctcggcctcggcgcgtcctgggagggcaaggtggaaggccccttcgggctgcccatgccccaggtgctcgactccgtcctgcgcacccccgagctctccaccctgaacctgggcaccctcgccgaacaggacgcgcgcgtgcgctggctcgtggtcgtcgtcgccgtgctggtgcttgccgtggccttcctcatggcggcccggtcgcccgccggtacacggctgtggcagcacgcggtccatatggcggtggcgctcgccctgacggtgctgttcatctgcctcaccgcccggatctccgcccactacgggctgtccctgctgggcctcggggacctgggcggcggactcggcggggaggtgtcgctgcgcccgaagctgtggacggcgctcgggttcgcggtgctgtggggcctggtcaccggcttcctcggaggcctcgcggcctcccgggtgcaccggcgcggcgaggtccccgacgcggggtccggctcctgagccgacaccgccctctcggtctcagccggcggccgggaac

SEQ ID NO: 4354 - DNA, 805 bp, Unknown
  Kingdom: Bacteria, Phylum: Actinobacteria, Class: Actinobacteria, Order: Streptomycetales, Family: Streptomycetaceae, Genus: Streptomyces
gctccggacgggtgctcgcccgggtccgtgagtcggccggggcgcagcgcggacgactggccctggccctgctgctcggcagcctggcggtcgggtcggccgtgggactcatggcggtctccggctggctgatctcccgagcctccgaagagccgccggtcatgtacttgatgatggcggtcaccgcgacccgcgccttcggcatcggccgggcggtcttccgctacgccgagcggctcgtctcgcacgacgccgtcctgaagctcctcgccgggctgcgtgtcgccgtctaccggggcctcgaacgcatcgcccccgggggcctgcgcaccgcgcggcgcggagacctgctgacccggctcgtcgccgatgtggacgcgctccaggactactggctgcgctggctgctgcccgtcggcaccgccgtcgtggtggggaccgcggccgccgggttcaccggctggctgctcccggaggcaggcgtgatcctggccgccgggttgctggtcgccggagtcggcgtcccgctcgtcagcggcgcctgcgcccgccgtacggaacgccggctcgcacccgcccgcaacgccctggccacccgggtcgccgtcgaggtcaagaccgacggccaccgctggaccaaggactacaagcgcggtgtcccgacggcaccgctggccaagcacgaggccaccgaggagaccggtacgacggtcaccttctgggccgacggggacatcttcgagaccaccgagtacagcttcgagaccctctcgcgccgcttccaggagatggcgttcctcaacaa

SEQ ID NO: 4355 - DNA, 1409 bp, Unknown
  Kingdom: Bacteria, Phylum: Actinobacteria, Class: Actinobacteria, Order: Streptomycetales, Family: Streptomycetaceae, Genus: Streptomyces
gggtgggccgggtcctcgcggcggcgggacacgtgcgtggcttcgcccatgtggagttcgtcctgacggccgacggacccgagctggtggagatcaaccgcaggatcggcggcgcgctggtcggcgaggtgctgtgccggacgctgcggaccaacgtctacacggccatgatggacgaggcgctcggccgccgcccggcgctgctggacaccgcgctcgacgcgggagggcccgcgtacggcttcgtcctggtgtacgcggagcggcccggggtgctgaagggctggcacggcctcgacgaactcggggcgttccccgggacggtggagtggttcccggtccgcgagcccggcgagaacgtgatccacgtcggcgatcagcggggctgtacgggcatggtgctggccgaggcgcgaacggcggagctggcccagcaccgggcgtggagcgcggccgtgcgggtccgcccggtcgtcgccggcccggcgtgagcccggggaggtgagcctccgccggacggacggggttccgggggccggtgcggaccgtggacggacgggccgggctcccgggcggaggggccgcccgccgctcaccggcccgcagcggttcctgctggcgggctcgttcctgatcaccctgggcagcttcgccgtgctgccctacgtgtcggtgctgctgcaccagcggctcggcctcggtctcggcacggtcggcctggtgctggccgtcgcttcgctgatccagttcgccggaggcgtggtcgcgggaccggtgaccgggcggatcgggctgcggcgcgcgatgctgctggcgctgggactgcgtacggcgggcttcgccgcgttcgtccccgggctgaccagtccggtcctcgcggtcggagcgctgctgctggtgtcggcgggtgcggcgctgtatctcccggcgaacaaggcgtacctggtggagggggcgtccgaggcgcggcgtccccggctgctgtcggcgagcggttcggcgttcaacgcggggatggcgctgggccctccggccgccgcgcccttcgtcatgggctcccccggtgtgctgttctcctgtgtcaccgtgctgttcgcgctcgtgggagccgggcacgcgctgctgccggccgggccccggagtccgacgcaccgcgccccgggccttcaccgttcgtggtgaccgtgctgagcgtgtacgcgttcatgttcttccagcactacctggcgctgtacgcggtcccccgtacgtcggcggccttctacggggccgtcctgacggggtacgcggccctcctcgtcgtcgcgcagccgctgctggcggaacgcgtcgccgcactgagctacccggcagcgctgcggtgggggttcggcgcgatggccgcgggcatggcgccgatcggggccggg

SEQ ID NO: 4356 - DNA, 543 bp, Unknown
  Kingdom: Bacteria, Phylum: Actinobacteria, Class: Actinobacteria, Order: Streptomycetales, Family: Streptomycetaceae, Genus: Streptomyces
ggcggagacggcggccaggacctggtgccgcgcggcgtcgtcgggctgcgcgtccaccttgtcgcaggccgcacaggtgaggacccgcccgtcgggcagttgtgtgccggtcgactcgtacggatggtcagcggtcgccacgacgtaaccccggctcgccagttcctccgcgagcccggtcaacgtggcccggggagtgccgaagccgggggagagcaggaccagggggaagcgtcccggcgccggacgggccgccgtacgggcatgggtgcgggtggcgccgaccagctcgggtggcacgacgtcctcaagaccgcgctgcgcgagcatcagccgcgcctcttcccccgtcatgtacggggccgggtcgccgccggtgccggggcgggccgggtagttcagcgacaccagcaactggcgcggcccggcggccggcacccaggggtcgcggcgcgtgtggtcggtcaggaacagggtgtcgcggccggtggcgtaccggccggtggggcggggaagcgccggcggggacgtctcggccaggtc

SEQ ID NO: 4357 - DNA, 651 bp, Unknown
  Kingdom: Bacteria, Phylum: Actinobacteria, Class: Actinobacteria, Order: Streptomycetales, Family: Streptomycetaceae, Genus: Streptomyces
  misc_feature (126)..(162): n is a, c, g, or t
tacaggggagtacggggcgggtgcgggcgtcagtcggccacgggcgccgtcaggcaggcgtccacgtgggtgatgagcgcgtcgtgcatggcctgtgcgccggtgcccgggaggccgggctcggtnnnnnnnnnnnnnnnnnnnnnnnnnnnnnnnnnnnnngccaggacctgggaggccagtccgtcgatcagggcggtgagggcgagggccgtgccgtccgcgtcgaccggacggaacacgccttgttcgaccccgcgacggatcacgtcggcgaccgtgccccgccactggcggtagtactccacgtggagccgtccgaccgtggtggaccgggcggcctcggcccacaggtcgagccagacgcaccactgccgccgttgctgttcggtgcggggtgtctggagctcgatcagcagacgcagctcgtccccggcgtgacgggtgccggccgtggcctcggcccggcgacgggtgtcctcgtccatgcaccagcggaccgccgcctcgagcagctcgtcacggccggggaagtggtagtggatcgccgccgtgctggtgtggcaggccgcggcgatgtccgcgacgcggacggcgtggaagccgcgttcggcgatgagccggacggtctcccgcacgatctgcaggggt

SEQ ID NO: 4358 - DNA, 2461 bp, Unknown
  Kingdom: Bacteria, Phylum: Actinobacteria, Class: Actinobacteria, Order: Streptomycetales, Family: Streptomycetaceae, Genus: Streptomyces
gcgggcggcgttccgcgggggtgagcagcagcacctccagggcccgggcacaggagcgggcctcggtcagcagccacccggtgcgttcgggggtgatcacctccggcgtggcccgtacggcgagggcgaagcgggcgtgccccgcaccgtccagcaccgggaccgccagggtccgtaccccgagcgccgactcaccgtcgttcaccgcgtacgcgtcggtccgcacgcgttccaactcccgctccagcgcggcggggtcgacgatggtgcggtcggtgaacgcgggcagcggaggcagcgtgccggggccaccctcacccggccgggcccaggccagcagcaccttgcccagcgccgtggagtgcagcggcctgcgaagccccaccttcggggtgacggagccgccggccacgatcaccgcgtgcggtccgctgcgcagcgcgaggtcggccgtcgcgccggtccgctccgccaggtcggccagttccggcgccgccagatgcagcccgcgctggtggtacgacagccggcccagctcggtcacggcggggccgagacggtagcgcgacgtgcgcgggtcctgctccaggaagcccgcggcgagcagcgtccgggcgagccggtgggcggtggagaccgggagtccgaggcggcgggccaggtcggaggcgctgaggtcggggccgttgtcgtggaaacagtgcaggacgtcgagggctctccggaccgcctgggcgccgcccggggcgcgtgccgccgcggtctcggtcatatcggttcactctccgctcgtgagtgggaaggacactccatcgttgccacattacgggagtgaggaaggggtctatccgtcacgggaaacatgctgttcatgtggaatcccacatcatgggaagcgagttgtcggcccgtccggatccgtggcaggcttcggccgaccccaccgacgagcggaaaggagccgtggaccatgtccggacgcaccgtcgtgcagtcagcccccgcccccggcgtcccggtgccgctcgctctcaccgcgcgccgccacatcgacctggcccgcgtctccagcgcctcctgtcgctgacccccgccgtacgccgcacgcggcgcacccgaactgccgccgggtcccgttcgacggaccggtagctccgggtcgagccgcgacacactccgcctcccgcgtccgcgcgtcccgtccccccgccgagcagccgttctcgccgcgtaccaccccatgtcccgcttccaccggcgtacggggatgaacggggtgtccccggcagccgcgtaccgcatcgcatccctcgccgttcaccggcctccgcccgtccagccgaccctcccgggaagacacctccatgacgcatgccgccgtcctgcccagcacactctggttcacccgttgtcctgttcccacggccaccggcatcgccgccgaccggcggtggctcaccgaggagttcgcccgggacggcatcgcggtgcgctccctgcaggacgccgaacccgacgccgaccgcgccgcgcactacacccacgcactgcccggcctcttccgcgagggcggcaacgtccctgccctctgggcgcgttcacgcggcgagcggacccggctcgtcggcctcacctggatcgaggagcgccagagcatcctggtcgctccccgctccggactgcgcggagccaacgcgctgcgcggatcgcgcatcgccctgccggtccactccatcgccatcgacttctggcgggccatggccctgcgtggcttcgagggggctctcgcctccgcgggcctcggcctcgcggacgccgtcccggtcgacgtaccggccgacggttcccgggagcagtggtcggccgaactggccgcgctgcgccggggagacgtcgacgcggtgtacgtcaagggagccctcgccgtcgaagcggcccgccggtccggcgcggaggtggccgtcgaactcgacgagctgcccgatcccgcccaccggatcaacaacggcaccccccggcccatcaccgtccaccaggacctcctggacgaacaccccgggctcgtcgaccgcttcctggccgtcctgctcagggccgccgactgggccgcggaccggccggacgaggtcgaccggatcctcggcgccgagaccggggccggggccgaaggggtcgcgggcgcctacctcccgggcacccaccgcaccctccaccccgacctctcgccgcgccgcctcgccctgctcgccgaacaggcgaaggccctgcgcacccacggcttcctccccgatgccgtcgacatcgactcctgggccgaccccgcaccgctccgccgtgccgccgcgctgaacggcacgccggtactcccgccacccgccactccctgaccccgaggaccaccgccatgcatgtcacccgaccactccgtaccactgctccggccgccctgctgccggccacc

SEQ ID NO: 4359 - DNA, 1515 bp, Unknown
  Kingdom: Bacteria, Phylum: Actinobacteria, Class: Actinobacteria, Order: Streptomycetales, Family: Streptomycetaceae, Genus: Streptomyces
  misc_feature (404)..(459): n is a, c, g, or t
  misc_feature (756)..(757): n is a, c, g, or t
ggaggcgctggtcgccaggagcgtggccaaacgcaggaacgatttcgcgacggcccgcgcctgcgcccggcgcgccatggccggtctcggcctgccgcccgtggcggtgctccacggtcaccggggacgaccgctgtggcccgaggggatcgtcggcagcctcacccactgcaacggataccgtgcggccgcgctggcccgtgccacggacgtgctgtcgctgggcatcgacgcggaaccgcacgccccgctccccagcggcgtaagggagttggtgaccctccccgccgaacgcgagcggatcggcccgcccgcgccggaagactcgggggaaatccactgggaccgcgtcctgttcagcgccaaggagagcgtcttcaagacctggtacccggtcaccggcnnnnnnnnnnnnnnnnnnnnnnnnnnnnnnnnnnnnnnnnnnnnnnnnnnnnnnnncacggacccggccctgccgacgacgctccacggacggtggcggatcgaggacggcatcgtcgccacgtctgtgctggtccggcccgaccggagggacagcgacgggtcgtgacgttcggccggccgggggagtggtgcgcagtgacgaccggcagggcggaggagtgtcgcccggcgaggttcggcagggcgggggagggccacgcagggatgttcgggaggccgaggccgggggatcgttgcgcgggggcattcagtcggccgtgggagcggtcggcgggcggcccagccccacgnnccgcccgctgagtcacctgggcaacgggaacgcgaccgcagcggccgccgcaggcttcgtccttgatcggtctcgccctacgccttcctgccctccttcgacgaagtgggcaaggacttcccggccggtctgctgtgggagttccggctttcgacgcttgcggtccaggtgacgctgtggagcgtcttcggttacctcactgaacggctcctggcgcccgcagcccttgctgcgacgcccggaccgcgcgtgcggtgagctgaggtccctgccgcgcgcacgacgtgcacggactgagacgcacgtactgacaacacgtacgcgctgacatgcacgaagggacccgccgggtacgccccggcgggttccttcgcgtgcaggcagatccgtcatgggtagcgatgtttgtgagcgttgctacgccacgagggtagcgatgataacgacatgatgttagcgttgatttcaccgggtttcacggaaccgccgcgaccccagtcgccaggagcaatgccatgaccgatcaggccatgaccggacagtccgcactcccctccccatcgacatccgcatcgacgaccggcgaacagcccaccggcgcgcagtccgcgcgtgccggtgaggctccccgccgggtagccgtggtcaccggcgggtcccggggaatcggccgtgagagcgccgagcgcctcgccgccgacggttttgccgtcgtcgtcaactacgcgggcaacaggaccgaggcggaggccgccgtc

SEQ ID NO: 4360 - DNA, 961 bp, Unknown
  Kingdom: Bacteria, Phylum: Actinobacteria, Class: Actinobacteria, Order: Streptomycetales, Family: Streptomycetaceae, Genus: Streptomyces
ccgtgtcgacccagagccaggtggcttcctcgcggctgaggacgtcctgggcgtcgtccgggtcgttgccctcgtactcggcgagccagagcaacgcgtagggccgcagcgatggttcggcgagcacggcgcggacctcgggttcggcgggggcgccgacgaccctcagcgcctcgaaggccagtccgcgcagcagcgcgtcctcgccccgggcgacggccagcagttcggcgacggcgctgcccacggtgcgggcggcgagccaggcgcggtattcgtcgcgggccgggccgggggtgagccgggcgcagccgaggagcatgtcggcggcggactgctcgatgttcccggccgggctctgggcggcgacgcagatctgttccagcttgacccagaccgcccagttgccgagcggggtgagggtggcgtgccctttgccgagggtcagggccccgacggcggcgaggccctccagggcccagtcgagcagcagggcgttgaggtcggcgctccgggcgggtccggcggcggtcccggccgccccggtccgggcggcggtctccgccggggcgggcgcggttctgccgggtcccaggggcacttcgcagcgctcctcctggagttcggcgacgcgctgtccgagaaggtccagcagtgcggggacggtgacggggcccgcggagagctgaaggagggagagcacctggggcactgcctcgacggcctcggcgaccgcgcccgcctcgatgtccgccggtgcggcgtggacgagcgaccaggcgtcgaagagcgccacccagccgcgcaggacggcggagtcgtcccggtcccaggcgcgcagccgccagccggggcgggcggtgtcgccgtgcagttcgatcagtccggccagtcgggccctgtcccagccggcgcggacctgcgccggggagagctccagggcggtggccgcccgttcgag

SEQ ID NO: 4361 - DNA, 1213 bp, Unknown
  Kingdom: Bacteria, Phylum: Actinobacteria, Class: Actinobacteria, Order: Streptomycetales, Family: Streptomycetaceae, Genus: Streptomyces
ccgcgtcggtgatcgagtagaccttgcggccgccctcggtggcgtgggtgaccaggccctcggcctccagcttggccagccgggggtagaccgtgccggcggacggggcgtacaggccctggaagcgctcctccaggaggcggatgacctcgtaaccgtggcgaggagcctcgtccaggagcttgaggagatacagccgcagacggccgtgggcgaatacgggaggcatgtcagagaacctttccggtcggctcggcggcgtacgcttcgtcctcggcgggcggcctgcgcaacagggcgatcgaaccggacacggtcgtcgcccgcagggtccccgtcccggcgcccagcgtgccggtgatcttcttcgatccccactgcccgtcgacccgcaggtcctcgaaggcgttggagacggacccgctcgcggtgttcgcctccaccctggcgtcggcggggtgcggcagccggatcgcgatctcgccggacaccgtggccagccggatgtccgcgggcttcccggacgggtcgacgtccagcaccatcgcaccgctgaccgactcggcccggaccgaggtccccgtcccgtcgaccacggtcaggtcgccgaacacggagtggaagcgcaggtcccccgtgacgctctgggcctccaggctgcccgacagggactccccgcgcaccgcgccggtcagcccgacgagtgtggagtcccccgtgatgccgcggacctcggtgcggccgctgatgccggagacgacggccccggcgccgatcacgccgacctcgaccgaggaggcggccggtacgaccagcgtgaccacagcgctgcggcggcggcccttggggtcgaaccagcgcaggaaaccctgccagggcaggtcctcgtaggccacggtgagccggccgtcctcctgggtcacgagcagcggcgggccctcgatcgcggagatctccagccgggcgtccggctcgtcggtcccgaccacattgaccgtgccgtcgacgatgcgcacgtggagtgccgtcaccggatcctcgaaggcgagcttccgaggctcggcgatggtccatctcgacacaggcatggatgtgacctcccggaaagcgtgacaacgcaacatatcgcgtcttgttcagaacacgatatatcgcggataggggaagtcaagggaagtcagggggagcccggggggacgagtgaggccaggag

SEQ ID NO: 4362 - DNA, 899 bp, Unknown
  Kingdom: Bacteria, Phylum: Actinobacteria, Class: Actinobacteria, Order: Streptomycetales, Family: Streptomycetaceae, Genus: Streptomyces
gatgcccccgctccccgccgtacgaggcagccgccagactcgtccgcgagcggtacgcgagacgcacccgcgccaccgcctccgccccgatcccgggctgatcgaccagaaggacgagcgccgcgtccgcgtccgtcgcgctcagggcggccaggcccaggcggagcgaggagcccatgccctcctcccagcccgggttcaccgtcaccgcgcagcccgagaggtccgcgcgggcccgcacctcctcggccgccgcacccagcaccacgtgcagcgggccgcagccgccgttgcgcagggagcgcaccgcgtgctcgatcagcgggcggccccggtgctccagcagcgccttcgggcggccgccgagccgacggccccctccggcggcgaggagtacccccgccaccttggggttcttcgcggcggaagccatgtccgcgctcctctccgtcgccgtgcccgtagtcgtgtccgtaaccatggggtctggataccactgagcgcttcgcacacgcgacacgcatgtcaccctcaggggtaaccccgatttctttccgtgggctggcgcgcactgcctgtcatggcgttaacttgcgggcacacccggggacttggccacagcccgggtgcgggggtcacaccggcacaaggatgtgcggagggggagtgctgtgttgcgaagcgtggggcagaagcggctgaccggcagcgacgaggacccgagggtggccgagctgcggatggccgtctcccggctacgccgcgaactggccgggctgcggaccgaattcccggaccggccgatcgccgaggacgagctggcggccctggacgcgatggccgtcagcggtgtgccggagatccctcgcatgcgccgttccctgctgctgatcgcgggg

SEQ ID NO: 4363 - DNA, 1656 bp, Unknown
  Kingdom: Bacteria, Phylum: Actinobacteria, Class: Actinobacteria, Order: Streptomycetales, Family: Streptomycetaceae, Genus: Streptomyces
ccccgcacacctgcccccgagcacgccgccgcccgcccggccggatgtcgcgcgggccgtggacgaggtgaagaagctgctcggcgagggccggatcacccaggccgtggacgtcctcggcgccacccttccggccgccgcggccgagcacggcgagcactcaccggtcgtccgcatcctgcgcaagcagtacgccgcgacgctgatggacgacgggcagtaccgccgcgccctgcctgagctgcgccgcctcgccgaggaccgcgccgccgaagcgggccagtccgacgcccaggcactccagttccgctacgacgccgcccagtgcctcgaacagctcggcgaagccggggcggcgctggtcgagtaccgcgcggtcctcccgtactacgagaacgcctacgggccgatcgcctccgatcccggccgcgcactcgacatccggcaccgcatcggacaactgctcctggcggtcggcgaccacaccgcgggccgggcacagctccaggccctgctgtacgacgccgagcgcacctacgggccgcaccacccgctgccgatggacctgcgccgcctgctcagccaccagcgggacgtccgcgggggctgacagcaccccccatagcggcccacatccccaactcctcccgaatcgttggtcgaatcggtggcaccggccacctccactgcctaacatcgatcaccgcaaggctttgtgcactgatgcacaaactctccccgggaggctcctttgcaccgccgtcgtcgcaccgcgctcgccgtcctcgccgcaacactcgtcgcggcgccgctcctttcggcctgcggcaaccagacccaccccggcgccgcggccgtcgtgggcggcgagcggatcgaggtctcggtggtccaggcccgcgccgcggacgtccgcagcgcccagggcagctccccgcaggccgcccagctggtgaacaagtcgggccagctcaaccgcgctaagctgcacgggctgatcttcggccgggtcctcgaccgcgccgccgccgacgcgggcgtcacggtcacccgcaaggagatccaggagatgcggaaggccaaccgcgcccagcagggcggtgaggagcagttcgaggcgatgatgctccagcagcgctgggtcgccccggaccagatcgacgccgacatgcgccaggaggtccagctcccgaagctggccgcggcgctcggcgcggacctgggcacaccggccggccagcaggccgtcggcgaggccctcaccaaggcgtcgaaggccctcgacatcgacgtcaacccgcgcttcggcacctgggacgaccagaagatgcagctcggcaactacagcgcgccctggatcacccaggtcaccgagttcgcgccgaaggactccccgacggacgcctgaaccggcaggccggaggcgccggggcagaggtaggttcgcagggtgaacgccgaagcccccgacgcctccgtcgggacccccgccgaccccggccgcatcgtcctgctcaccgccagccaccgggtcgcgcccggtctgctgtcctggccggcctggcagacgctgcacgcggccgaccgggtcctcgtcgccgacccggaccacccgcagctcccctacctccgcgaggcgggcgtacgggtcgagca

SEQ ID NO: 4364 - DNA, 555 bp, Unknown
  Kingdom: Bacteria, Phylum: Actinobacteria, Class: Actinobacteria, Order: Streptomycetales, Family: Streptomycetaceae, Genus: Streptomyces
gccgcgggccggcccgcggcctcgtccaggacgtgctggtacggggtgccgtccggggcggggaagcaggtgcgcaggctctcctgccggccggtgacgtcaccgagcgcggcgtgcagggccgcggtgtccagctctccggtgaggcggacggccaccggcacgttgtacgcggcggacgggccgtcgacctcgttgatgaaccacagccgctgctgggccagcgacagcggtacgcgctcggggcggggccccgggaccagcggcgggtgcgcggccccggcgctgtccagccgggcggcgagtccggccacggtggggtgctcgaacagggcgcgcatgggcagttcgacgccgagcaccgtgcggatgcggccgaccagccgggtgaccaggagcgagtggccgcccaggtcgaagaagctgctttcggggccgacctcgggtaccccgagcacatcggcgaacaggccgcacagcagctcctcgcgggggccccggggcgcgcggcccccgcctcccgcgccgaacccgggggcgggcagcgcggcccgg

SEQ ID NO: 4365 - DNA, 3015 bp, Unknown
  Kingdom: Bacteria, Phylum: Actinobacteria, Class: Actinobacteria, Order: Streptomycetales, Family: Streptomycetaceae, Genus: Streptomyces
cacggccgcgatgctcgcccaggtggcgcacctgggcgagcatcgcggccgtgaaacgggcgtgaaccaggccctgatagagcacgtcgggctcctcccaggccagcaggacctgggccaccgggcccgtccacagcccggcggccgtcccgaccggcaccggcctcgtctccgcgtccgccgcctcggcggccgccacgcacagccggtgcccttcgcacctgcggtggagacgggcggaggagttggtcgcgtcgcgcagttcgacgagcacgggagcggcctgcgccagcatccggtccccgtgttcgaccacggccatctcgcccagccggggtccgagcaggaagcggccccggccgtcgcgggtgaccagccgcagccgttgcagtgccagcgcgagccggtgagcggtaggacgggtcagcccggtgagcgcgacgatccgggacaccgaggcgggtccgtcctccagcacgctcagcagcagggacgccttgtccagcacggcgaccccgctgtcgtgccggagcgtggccgtgggagagggccaggtcgtcatcggacaccgcccagggaccgggcgagcgagccggtcagctcggcgtgccggtcgacgaggtagaagtgaccgccgggaaggacgctctgccggaagccggcgggggcgatgtcggcccaggccgccagatcggccacgctcacggcggggtcgcggtcaccgccgtaggcgtggaccgggcagccgaccggcacggcggcgcgcggtccgtaggtttccgcgatctcgaagtcggcccggatcgcgggcagcaccagcgcccgcagctcggggacggcgagcgcggcggcgtcggtgccgccgaggcggaccacctccgcgatcagcgcccggtcgtcctccagatggaggcctcggggggtgagccggtgcggaggtttccggctggacacgttcagtcccgcgatgcgcacggagtgccgggcctccagccgcagcgccacctcatgggccagcgaggcccccatgctgtgcccgaaaagcgtcagcgggaggtccgtgaacggcagcagcgcggcggtcagacggtcggccagcacatccatgctgcgcaccagcggctcgtcgagccgggtgtgccggccgggatagcacgccaccagtacctcggtctccgggccgaacgacgctccccaccggtggtagaacgcggcggatcctccggcgtgcggcagcaccacgaaccgctcgccgggagccgccgcctcgtaccggcggaaccatccgtcgccgatgcctgccttcatactcttcgcacctcgcgtcagcggaacagatttcggcggtagtggccgtggtcgtacggaactcgccggtacggagaccggcgacaagggactcgccggtacggaacgcgccgccccgaggccgacgatcaccgcagcttgttctagccgcccggttccgggccggacaacgggtacttcaggaagctgccacacccgacggccggacacggagggctcagccctcggcacgggactgggggttctgcgttcccccggcgctccccgagcccaacaggcccagctcggccgcccggacgccggcctggaaccgggagctggcgtcgagcagggtcatgatctccgccacatagcgccggtaggtgcgcaccgagaccgtcagctcgcgcgcggccacctcgtccgtggtcccggcccgcagcgcacccagaatctggcgcgcgagatcggaccgggagtggtcgccgaacgtgatgcgaccgtcggcggccaccgcgttgccccagaccccgtcgtagagggtgcagagggtgcggatgacgtcggggacccggatgagcgacgcccggcgtccggtgggcgactcggcggagaccagcgccacggagtcgtccacgatcatggcctgtaacgggggaacccgcgccacccggacctcggccgacgtcttccgctcgcgccggtcccggacgaagtcctcgtcgatcatggccggcgagcagagcaggcgcagccggacggtctcgggcaccagacggatcagctcggccagagtggccttcgcctcggccccgcagctcggcccggcggccagcaccacgtcgatggtcgcggtggcctgaaacaccaacttcctcgcttcacccatcacttcgggtttgcggccgtccacggcggtgatcagctgatcccacgagacccggtcgcgatgctgctccacagtggtctcgatcagagcccggacctccaacagggcccgctctatggcgtcctggccgccccccggatcgtccggccggtcccgggcgtcggcctccccgggtctgtgcggctccttccccgccgccgcttccggcccggctccttccgccgccgccggctcacgcccgccttcgcccgggtcttccggtcctgtcgccgatgttgtcctgatcatcctgtcccccgatattcgccagccggcaccgccgcccgaggcggcggctcagcaccgctccagcagacccagctcgacggcgcgtgccccggcctggaaccgggagttcgccccgagctcgcgcatgatgtcggctacgtgacgccgataggtgcgcagcgagacgtcgatctcccgcgcggccacgtcgtcggtgcgccccgcgcggagttgctccaggattcgccgcgtcagcgcaccgcgcagactgcggtccagccacagttcgtcggcgaccgggcgggcgttggcccacgcccccgcgaagagcaggtcgagcgcacccaccgccgccgggtcggtgatgatcgcggcatgccggcccgccgatccgttgcccgactggaccagggccgtgcgcccgtcgacgatcagcgcctcgcgcagctcgcccttggtcatgcgtacgtccagatacgtctcggcgaacgaccggtggcagtccgcggtgagttcgagcgcgccgccggaggcgagcagcctgacggcgagccggccccggccctcgcgag

SEQ ID NO: 4366 - DNA, 695 bp, Unknown
  Kingdom: Bacteria, Phylum: Actinobacteria, Class: Actinobacteria, Order: Streptomycetales, Family: Streptomycetaceae, Genus: Streptomyces
cgacggtggcgtcaccgcgaccgtcaccgccggcctcggtgtccggggctgggcggcggcccccgacaccgccacccgggtgccgcaccggccggagacggcggaagctccggcgtccccggtccggccggaggacgcggaagtcccgagggccccgttccggccgggcacggtcaacatcgtcgtcaccctgcccgtcgcgctctccgacgccgccctcgtcaacgccgtcgccaccgccaccgaggccaaggtccaggccctcctggacgccggactcgactgctcgggcacgcccacggacgccgtgtgcgtcgccgcccccgaaccggggcacgacggcggtgaacccttcgccggaccccggtccacctggggtgcgaggatcgcccgcgccgtgcacaccgccgtactggcaggggcccgcacggcaccgtgacagggccgctccggatcagaccacgctcaccggatgccgcaccaccgcgtcgaacaggtagccctgcgtgttgtgcgccgcggccaccggctgcgtacggcccgaacggtccgtcgcccgcgccagcagcacggccggtccccgctccttcggcacccagtcggccgtccagcggacccagctcccggcccgcggctcgtcccgcagccgggcccgccgccagtgcgtcccgccgtcggtgctgacctccacggcc

SEQ ID NO: 4367 - DNA, 3014 bp, Unknown
  Kingdom: Bacteria, Phylum: Actinobacteria, Class: Actinobacteria, Order: Streptomycetales, Family: Streptomycetaceae, Genus: Streptomyces
  misc_feature (2831)..(2874): n is a, c, g, or t
ctccccgcgcgcccgaacccgcgcagcagggctgggaccggcccccggagtggagccgcccggcgtccgggccggtgcgtgcgccctcggggtcccgctacgaccagcaggggcgcaacggtcagggcggacggttcggctggctgggggaactgctcgtcgccctcgtgctggtggtgctgggcattctggccatcagcgtggtcggcgcgatcatcgcggagctgatggacgcggggcccgcgtcgggggacagcgccgtcttcttcgaggacccggtcgccgatctggtcgtacagctcctgggcatagcgatcggcataccgatcgtcctgtgggtagcccgcggactcggccgacggccggccgggaccgtgtcctccgtcgtcggacggttgcgctggggctggctcggacgctgcgccgccgtgggcttccccctgatggccgtgcagatgggcctgatgatcgcctggacctgggacgcggaaccgctcccggagtccggtgcgggcttcccgggctggccctactttctgctgagcctggccgtggtgctggcgctcgtcccgttccaggccgccgccgaggagtacgtcttccggggctggctggtccaggcgatcggccgggtcgtgcgttcgccctggcccgcgatcgtcctcgcgtctctcctgttcgccctggcccacgggttcggcgaactctccggcttcctgctgctgctctactcggcgctgtggtggggttggctggtgatccgcaccggcggcctcgaagcggtgatcgtcctgcacgtcgccaacaacgtgctggccttcggcctggcggcgggcttcgggatgctcgacgacagcagcaccgcggccgacgccccctggcaggccctggtcctcgaactcgtcttcgccccgctgtactgcctgaccgtggcgaagatcgccgagcgccgcgggaccgagcgggtcagcccctgatccccggacccggcccgggcgggctccggaccccggtcctcctcacgtcgcgttcagcgccaccgtcgggtgcaggcgggcggcgcggatcgccgggtagaggcccgcgaccacgccgatcagcagggtcgcggccaggccgcccgccagggaccagggcgggaccaccgccgtccacccctgcgcccgggcgaacccgtacgtggccgccgcgcccagcaacgcacccgcgacgccgcccagcgcggacaggagcagcgactcggtcaggaactggagccggatcgcgttgcgcgtcgcccccagcgagcggcgcagaccgatctcctggcggcgctccagcacggagatgaccatcgtgttggcgacgcccaccccgccgaccaggagagccaccgcgccgagcccgagcatcagggtcgtcaggcccttgtcggcggcggcgcgggcggccagcgcgtccgaggggcgcgagacccgcacaccggcctcgttgccggggctgaccgtccgggccagcaccgcccgtacgtcctcgaccgaggcgtccgatgagcgctcgaagatcgtggtggggcggccgtcgaagccgaagtagcgggtcgcggcggggaatccgatcagcgccacccggtccagggtcgggaccagctcgacgggttcgaggatcccgacgacggccacccgggtgtcgttcaacatgatcgtctcgccggggcgggtgatgccgaggcggtccgccgccaccgcgcccaggacggcggtgggcaggcgctcgccggccggggtcagccaggtgccccgcgccacctcaccaccgagcgtggagagcaggtcggtccgggccgcctgggtggtgacgccggcggtgcgctcctcggggacgacgtcgctgcggcggatgcgggcgtcgacctcggcggtggccgtggcgtgtcgcaccgggccgatccgctcgaccatcgccaccgcgttcctggggagttcgaccgtgcccccgagcgggtcctcgccggcctcggcggtgagaaggttggtgccgaggcggtcgaggcgggacatcagctcggcacggctcgactcggacaggccgacgaccgcgaccatcgtcgcgatgccgatggcgatgccgagcgccgagagcaccacccgggcccggcgcgcccgcagtcccaccgcgccgacgcgcaggacgtcccggggggagaggcgggcgggcttgagtgcatgggtacgggtcatgcgccggcctccgtacgcggggtgggcgcggtggagcacgcgcccggtgcacggggggtgcgttcgtccgcgatgatctcgccgtccctgaagcggacccggcgcggcagcgaggccgcgatcccgtggtcgtgggtgatcacgcagaccgtggtgccggacgcgttcagctcgtgcaggagctccatgacgatctcgccggacgcggtgtccagggctccggtcggctcgtccgccagcagcagccggggttctcccaccagggcgcgggcgatggccacgcgctgtttctcgccgccggacagctcgttcggggtgtgcgcggtccggtgctccaggcgtacgcggaccagcgcctcgcgcgcccggtcgcgccgctcccgggaggggacacccgtgtacagcagcccgtcggcgacgttgtccaccgcgtcgcggcccgccgccaggtggaagtgctggaacacgaagccgatgtggcgggcgcgcagggcggagaggcgggcgtcggagagcgcggacacgtcgtgtccggcgacccggaccgtacccgtggtgggccggtccagggtccccatcacgttgagcatcgtggacttgccggagccggannnnnnnnnnnnnnnnnnnnnnnnnnnnnnnnnnnnnnnnnnnngacttgccggagccggacggtccgaccaccgcgaggagttcgccctcgtggacggtgaggttcacggcacgcagggcgtggacgccgcccgggtaggacttcgtggcgttccggagttcgacgacggggaccacgggggc

SEQ ID NO: 4368 - DNA, 1006 bp, Unknown
  Kingdom: Bacteria, Phylum: Actinobacteria, Class: Actinobacteria, Order: Streptomycetales, Family: Streptomycetaceae, Genus: Streptomyces
acgccgcgctgctggccgccgcgctcacccacgccgacggcgacttcacccggtcggtcggcctcgcggtctccggcggctgggacaccgactccaacggggcgaccgccggatcgctggccggactcctcgcgggtgggccggacgccgtgcccgagcactggacggctccgctgaagaaccggctcgccacctccgtacccggcttcgacaggaccgggttcgacaccctcgccgcactgacccatcaggaggctctgcgcccatgacccgcatcgcggtgctcggcagcaccaacatggacctcgtcgcctacacggcccgcgcccccggacgcggcgagaccgtcaccggacgggagttccggacggtccccggcggcaagggcgccaaccaggccgtcgccgccgcccgcgcgggcggggaggtgacgatgatcggcgcggtcggcgacgacgcctacgggaccctgctgcgcgacggcctcgaacacgcgggggtcgacaccgacctcctgcacaccgccgagggccccagcggcaccgcgcacatcgtggtggacgacaccggggccaacgcgatcgtggtgatccccggcgcgaacggcgtcgtcaccgcgctcggacccggggagatcgcggcgatcgccgccgccgatctgctgctgatgcagctcgaactccctctgtccgccgtcgtcgagggagcccgcgcggcgcggagccagggcgtacggaccgtcctcactccctccccggcgcagcctcttcccgacgaactcctcgaccacatcgacctgttggtgcccaacgagcacgaggccgccgagctctccgggcaggccgaaccgcacgccgccgcccagatcctgctgcgtcaggtgcccgaggtcgtcgtcacgctcggcgcgaagggctgcctgtacgcggcccggggcggcgaaccggtgctcttcgaggccccgtcggtgaacgccgtcgacacgaccggagccggggacaccttc

SEQ ID NO: 4369 - DNA, 2192 bp, Unknown
  Kingdom: Bacteria, Phylum: Actinobacteria, Class: Actinobacteria, Order: Streptomycetales, Family: Streptomycetaceae, Genus: Streptomyces
tccgcccgcagcggccgggagctccgcgtcccggccgctgcgggcggagctgctggaggtcctgctggagttcgagcaggtcaccggccgggacccggatgtgctggaggcgctgctgcgggccgccgccgagggttcggaacgccgcccggagatccgtacgcgcgcactcgtccaccgcaccgggatgctgttggtccgcacccccgaaggcgccgcccggttcgaccgcggcctggtcgaactcgcccgcgacgtgcccggattcgccgccctcgtcacccgctggctggccgacgccccccaggagtgggctgcggtcgtgggcccgagcgcccggcgcaccgtcgaggcgttggagacatcacgtccgccgatgccgatgccgatgcaggcggcgggacgtgagcatggcagtcttagacctgcgtaatcgacatacacacgtacacaggttcgggcgaggagcggtcacagtgcagcgctggcgtggcttggaggacatcccccaggactgggggcgcagcgtcgtcaccatcggctcctacgacggcgtgcaccgcggacaccagctgatcatcggccgggccgtcgagcgcgcccgtgagctgggcgttccgtccgtcgtcgtcaccttcgacccgcaccccagcgaggtcgtccgacccggcagccacccgccgctgctcgccccgcaccaccgccgcgccgaactgatggcggagctgggcgtggacgccctgctgatcctgccgttcaccgccgagttctccaagctgtcgcccgccgacttcatcgcgaaggtcctcgtcgaccggctgcacgccaaggccgtcatcgaaggccccaacttccgcttcggccacaaggccgcggggaacgtcgcgctcctgaccgagctgggagccgcctacgactacaccgtcgaggtcatcgacctgtacgtcaccggcgaggcgggcggcggacagccgttctcctccacgctcacgcgtcggctgatcgccgagggcgacgtcgccggggccgccgagatcctcggccgcccgcaccgggtcgagggcatcgtggtgcgcggcgcgcagcgcggccgggagctgggcttcccgacggccaacgtcgagaccctgccgcacaccgcgatccccgcggacggcgtctacgccggctggctggaggtggccggcgagtcgatgcccgccgcgatctccgtgggaacgaacccgcagttcgacggcaccgagcggaccgtcgaggcgtacgccatcgaccgcgtcgacctggacctgtacgggctgcacgtggccgtcgacttcctcgcgtacgtccgcggcatgctgaagttcgactcgatcgacgaccttctggtcgccatggccgccgatgtgaagcgctccagcgagctgaccgcggcgtacgacctcacccactgacgtacccccaggccgtgcggtccgcccgagcacggcggatgctgacagggtgcgcgacatcctgcccgacctccgtgcccggtgctccgacggcatccccttcgccctggcgaccgtcgtcgccgtgcacggcagcgcgccccgggaccccggtgccgtgctcgccgtggacgcggcggggacagtggtcggcagcgtctccgggggctgtgtcgagggcgatgtgtacgaggtcgcccgcgacgtgctcgccggggcggggccgcgcgtggtgtcgtacgggatcagcgacgacgaggcgttcggcgtcggactgacctgcggcggcacgatcgaggtcctggtgcgcgcctacgcgaccgccgccgaacgcgaggatctcgcggccgtgctggacctgatcgccgccgatctgccggtggcagaggccacggtcctgtccggcgcggcggagaccggggcccgcatggtcgtccggcccgcacctgctcccgacacccccgacctcccccttggcactctcggttcggaagggctggatgccgccgtcaccgacgacgcccgggggctgctggcccaggggcacaccggaatccagtggtacggggcgcacggccagcgccggatgcaggaggtcgccgtcttcgtccggacgtacgccccgccgccccgcatgctcgtcttcggcgcgatcgaccacgcggcggccaccgcccgcatcggctcgttcctcggctaccgggtcaccgtctgcgacgc

SEQ ID NO: 4370 - DNA, 515 bp, Unknown
  Kingdom: Bacteria, Phylum: Actinobacteria, Class: Actinobacteria, Order: Streptomycetales, Family: Streptomycetaceae, Genus: Streptomyces
gtagcccacccacccccggggtaaggggtaggaggtgtcgcgcgacgaccgcgcccccgccggggcagcggacacgccgcctgcgacgacacctatcctgagagggtcggacagcgcggtccgcacccgctcgtcggggcgtggcgacagcaccgctgccagccgcagggccccggaccccgccacccgtccccacatcacgcaacggggacggcgaagcgaacgcacctcctcattcactgcaaggagccgcacactgtgagcagtgccgaccagacccctgccgccagccccgcgctgcgcgccgacatccgccgcctcggcgacctcctcggcgagaccctcgtacgccaggagggccaggcgctcctcgacctcgtcgagcgggtccgcgccctgacccgcaccgacggcgaagccgccgccgagctcctcggcgacacggacctggagacggcggcacagctcgtgcgtgccttctccacctacttccacctcgccaacgtcaccgagca

SEQ ID NO: 4371 - DNA, 2622 bp, Unknown
  Kingdom: Bacteria, Phylum: Actinobacteria, Class: Actinobacteria, Order: Streptomycetales, Family: Streptomycetaceae, Genus: Streptomyces
  misc_feature (1935)..(2012): n is a, c, g, or t
cccccgacccgcgctccaggaaggagccgcatgacctccgacgccacccccctgctcaccgtggacgactgcgaacaactgtcgacgagccaggtgcacgagctgtaccggtcccacgtcaacaagagccaggtctccctgatgacctccttcggcttcggccgggaactcgtcgaccacgccgaagggtcctggatccacacccgcgacggacgccggatcctcgacttcaccggcggcgtcggcgtcctcaaccacggccacaaccatccgcggatcctcgccgcccgccgccgcttccaggaacagcgccggatggaggtccacaagacctacttctcgccctacgtcgccgccctcggccacaacctcgcccaactgctccccggcgacctgaacctgtcgttcttccccaactcgggggcggaggccgtcgagggcgcggtgaaactcgcgtacaagtaccacggaggccgccgacagcggatcctgcacgccgacatcagcttccacggcaagctgctgggatccggcagcctcaccggcagcgcccagaacgccttcgccttccccggcatccccggcgtctccgccttccgttacggcgacctcgactccgtaagggaagcggtcgccggagcccgggacgccaagggccgctgcgacgtctacgcgatcctcatcgagcccttctccgcctccacgatgacggagtgctccgaggaattcctccgcggcctcagggagttgtgcaccgaggagaagatcgtgctggtcttcgacgagatctacaccggctggggcaagaccggcagcctcttccacttcatgcgctaccccggactcgtcccggacgtggtgaccacctcgaagtccttcggcggcggcaagtcctcgatctccgccttcgtcgcccgcgaacccgtcttccgcgaggcctacgacagcctcggcgacgccatgctccagtccaccagcaccacctactacggcttcggcgaggagaccgccaccgcgctggaggccgtcaacatcgcggtcgacgacgactatccggcccgcgcccgagccatcgaacgcgtcctcgccccgggcctggagcggctgcgcaagcagtaccccgacatcatcgcggacgtccggggagccggagcgctgtacggcatcttcctcgacggcggcccccggctcctggacctcgccgcgaagatcgctcccggcggactggcccgcgacccgatgctgcgcaccaaggtcatcacctgcgcggtcgtcaacgcgatgtaccacgaccacgacgtgtacatgtactacacgctcaacggccgcagtcctctggttgccgccccctccctggtcgccggacccgacgaggtggagatcttcctcgacgccttcgacaggaccctggccaagggcatgaaccggctcctcaccgccttcctcaaggacaaggcggtgtcgcgatgggcggcctgaccatcgccgtgaccggagccgccgggatgctcggctcccacctggtggccaggctcgccgccgacggccacgacgtcgtcggcgtcgacctgcgcgacgatccccacccgcccgccggcgcccggcacctcgtcgccgacatccgggacgcggccgcactcgcccgcgccttcgacggggctcacgcgctggtgcactgcgcggccgcactgcccagctaccccgtcgaccagatccgctccatcaccgtcgacggcacccgcaccgtcctgaccgccgcgcaccgggcccgcgtcgagcgggtcgtgcacatctcctccaccgccgtctacggactccccaagcgggtccccaccccggaggagcacccccgcgagcccgtcgacccgtacagcagggcgaaggccgaggccgaggaggtctgcgaggagttccgggagcggcgcgggatgtgcnnnnnnnnnnnnnnnnnnnnnnnnnnnnnnnnnnnnnnnnnnnnnnnnnnnnnnnnnnnnnnnnnnnnnnnnnnnnnngcaccctgcgcgaggacttccaggccgtgctggacgcggccggacacggcaaacgcgtggtcccgctgccggcagcaccggcactcgcggtcctgcgcctgctggagcgcaccaagctctccccggtctacgggcggcttctcttcaagctcctcgacgacagttacgtggacatcggccgggccaccgaacggctcggcttccgtcccgcgctctccaaccaggacgccatcctcggcacgtacgcgtggtggcgcacccagcggcagggcagcgcacccgctcccggagccggccggaccagccgggacccgtggcgccaaggggcgctcggcctggccaaggtcttcttctgatcccctggagccctgccgtggacatcacccggtcctcacccgcgcccgtgcgcgtggtggcagtcccgcccgaacccgccgacgtcaccgccctgcccgaacccatcgccgtagagcctcttccgaccgcgacccccgccgacgtacggggccgccgccgcccccggccccgcgacctcctcgcgctcctgcgtcccggccagtgggtgaagaacctggccgtcgtcccgctcgccctgctcgacacccacccc

SEQ ID NO: 4372 - DNA, 702 bp, Unknown
  Kingdom: Bacteria, Phylum: Actinobacteria, Class: Actinobacteria, Order: Streptomycetales, Family: Streptomycetaceae, Genus: Streptomyces
ggcagcaccgagggctccggaggcaccgccgggaccgggggcggcgagagctcgggttccaccacgacgggcggcggcaccggcggacctgacgacaccgggcgccccggcaccggcgaggacaccttccccgaggacaacgaggagcccgaggccgcccacgacgtacaggcgtccgacgacggcgagggcgagggcggcggcgagcaggccgaggagcaggaggactgcggcggctggggcttcttcggctgcgcctgggaccgtacgacacaggtcgtcaagggcatcgtggtcgacgggatctggggcgacatctccgggatcatcgacctgttcaagccggagacctggtccggactggtcgactacggcaagcagctcggcgaccagtggacgaaggactcctcgggtgcgggcgacaaatgggcggacggcgactacctgggcgcggtcctggactggggcaaggcgtccgtcggcacggtggtcacggtcggcgacgacatcttcgtcggggacgaggtccgcgagcgctggaacaacggcgagaagacccgggccgtcacggatgtgatctggaacgtcggctcgatcttcatccccggctacaacgtcgggaaggtcgtcgggaaggtcggcaagctcggtgtgctgggcaaggtcgccggggccgtgagccgtgccgccgacgacgccggg

SEQ ID NO: 4373 - DNA, 604 bp, Unknown
  Kingdom: Bacteria, Phylum: Actinobacteria, Class: Actinobacteria, Order: Streptomycetales, Family: Streptomycetaceae, Genus: Streptomyces
cctgggccgggcggcccgggccgcgtcgccgcagtcgcgcggggcgctgagcgcggcggcgaaagggttcagcaaggacgccgttccgttcgacgcctacctggacgaggacggccggctgcggaaggtccggcaccggttcaccttctcctccgagggcccggaggtgtcggtggtctcgacgctgttgctgtacgggttcgggctgccggtcacggtgacgctgccggacgaggacgccatctacaccggcgagatccggcaggggtgagggtggcggccgggacgggccgggcggtggggccggttgtgaggggcgcaaaatggtccgtccgtgccatgcgcggtgcgcaccgggctccctaggctgggaagccggtgtgccaggggccggtgacggcggggatacggcagagagaagtgacgcaggtggtgacgctcagggctccgaacgcgcaggaccgtgtggccctcgccgagatcgagctgtgcggcgagctgatgatcgccgcgtcggcggcgggcgaggaacgcctcagtcccgaccggatcgacgaagtgctcgacgtccgcggtgcggagtcctggccgacggtcccccggc

SEQ ID NO: 4374 - DNA, 1174 bp, Unknown
  Kingdom: Bacteria, Phylum: Actinobacteria, Class: Actinobacteria, Order: Streptomycetales, Family: Streptomycetaceae, Genus: Streptomyces
ggcgcgtaacaccgaggcattacggttgaccggggtacggatcctgtgcggatcggtaccccggtttccttttggttcgtgggaggacgacgtacatgggtatccaggacacgcccgaggagtggcaggtcaccgcgaccgtgacccccttcaccggcaacaagaccagcgtccgcaccgaccaggtggtgatgcccgacgggtccgtccacggccgggactaccaggtgcaccccggctccgtggccgtcctcgcgctcgacgacgacgaccgggtcatcgtgctgcgccagtaccgccacccggtacgccaccggctctgggagatcccggccggtctgctcgacgtccccggcgagaaccccctgcacgccgctcagcgcgagctgtacgaggaggcgcacgtcaaggccgaggactggcgggtgctgaccgacgtctacaccacgcccggcggctgcgacgaggccgtgcgcatcttcctcgcccgcgatctctccgaggcggagggcgagcggtacgcggtctccgaggaggaggccgatatggaacacgcccgggtgccgctgcccgagctggtccgctcggtgatcgcgggggacgtgcacaacaactgcctggtcgtcggggcgctcgcgctctccgccgtgcgcgcgggcgacggcgtcgactccctgcgccccgccgacgcgccctggccggcccggcccttcgaggcctgacgggcggacggactgacggacggacggacggactgacgggccgtctgccgccgtgcaccgcacccccgatcggacgatcgcagaacctggcggtcgtaaaaagtgaagaaatgctgatccgatcgggggatgttcctcgtgctccgccccactccgcagtgatcgtcgtcaccgctgaactacgctcgaaatgcacccgaccggagttccggcgggcaccgcgtgcagcgaagtggagcgtggctcgtgaccgatcaggcggtggacaccagcggcccggcaaaggccccggggaccaaggagccgtccggcaccgtcccgccccgattcttcggccgcgaacgtgagttgaaggccctgcgggcggacatcgagcgcgccggcctcgacaccctggccggtcgcaagacccctcgcgccagggtcctgctcatcgcgggccggcccgcgat

SEQ ID NO: 4375 - DNA, 655 bp, Unknown
  Kingdom: Bacteria, Phylum: Actinobacteria, Class: Actinobacteria, Order: Streptomycetales, Family: Streptomycetaceae, Genus: Streptomyces
tcctgcgcgagccgctcggcatcgacggagcgccggccgcccgcaccggcgagagcgccgagcggctcgcgcaggaactgcggctgctcggccgtgcggtgctcgtggtctccaccgagggattcctgcgcccggcgagcctgcgtttcgagtacggcaagcgggacccggacgcgtacgtcgacagctggtacgacaccggggcgctgtggcgggaggtgttcgggccgctggaggcgggcggctccggccgtgtgctgcccgatctgtgggaccccgtgaccgaccgggccacccgtaccccgtaccactcgctgcccgagggcggggtcgtcgtcgtgcacgggccgttcctgctgggccactggttcccgttcgcgctgagcgtccatctgcggctctccccgggggcgctgcggcgacgtacggcggagtcggagcgctggaccctgcccgccttcgcccggtacgaggacgaggtggcgcccacggagcgcgcggacgtggtggtccgggcggacgacccgtcgcaccccgcctggtcggggctgcccgggagcgggtgaacccgcgcacggcgtgacacggacgccaccggacgggcggcggccgcttccggacggcggcgtccgccgctatcggaccggcggtggcc

SEQ ID NO: 4376 - DNA, 1378 bp, Unknown
  Kingdom: Bacteria, Phylum: Actinobacteria, Class: Actinobacteria, Order: Streptomycetales, Family: Streptomycetaceae, Genus: Streptomyces
ccctggagccgtccgagctgatcctgccggcgcccgacgccaccctcgaagacgtacgggccatgctcagcgacggcgggctcatccccaactgagaccgaccggcaccggcgggcccgcggatcgccgcaccagcaccccaagcgcccctgccccgcgcccggtccgccggccgcggggcaggggtgctccgggccctccccggggaagacgtacgcccccgcggaccggccgcgtaccgtagctggacgtgaccaccctctcgtccggcttcgcgcgcgcccgtcgctggctccgggaccatcccctcgcgttcgacgcgaccctcgccctcggctctctcgtcgcgatgatctgcggctcgttcgcggacccgggcaccggacacgggccgaccttcggcacccgcactcccgagccgttcagcgtgctcctgatggttctcgcctccgtggccctggtcctgcggcgacggcgtccgagggcggtgctcgccgccaccggggtcctctcggccaccgagtacatcctgatggacccgcccgccccggtcgtcatgagcgcggtcgtcgccctctacaccgtcgcctcgcgcaccgaccgccccaccacctggcgggtcgggctgctgaccatgggggcgctcacggcggcctccatgttcttcggctcgacgccctggtacagccaggagaacctcggcgtgttcgcctggaccgggatggccggggccgccggggacgccgtacgcagcaggcgcgcgttcgtcgacgccatccgggaacgagccgagcgcgccgagcgcacccgcgaggaggaggcccgccgccgggtcgccgaggagcggctgcggatcgcccgggacctccacgacgtcgtcgcccaccacatcgccctggtcaacgtccaggccggggtcgccgcccacgtcatggacaagcgtcccgaccaggccaaggaagcgctcgcccacgtccgcgacgccagccgctccgcgctcaacgaactccgggtcaccgtcggcctcctgcgccagcagggcgaccccgaggcgcccaccgaaccggcccccggactcgcggtcctcggcgagctggtcggtaccttccgcaacgccgggctccccgtcgaggtcgcctgctccgaccacgggaaccggctgcccgccgccgtcgacctggccgcgtaccgggtcatccaggaggccctgaccaacgtccgcaagcacgcgggcgccggggccagggccgaggtgagcgtcgtacgggtgggtgccaccgtcgaggtcaccgtgctcgacaacggccgggggagcggcggccggcgacccggctccggggccgacgacgacctggacagcggcggtcacggcctggtc

SEQ ID NO: 4377 - DNA, 1319 bp, Unknown
  Kingdom: Bacteria, Phylum: Actinobacteria, Class: Actinobacteria, Order: Streptomycetales, Family: Streptomycetaceae, Genus: Streptomyces
atctggctgccgccgggcgacagcgcaaccccgcggcgtacgccctggtgtggtcgccccggtggagcgtgtcgtacagctcgcccggcggtcggcctcgaccccctgctggaggcgaagctgctggcaccttgacgtgccgcttccgtgtgcgtgtcgcggcgaagaaacctcctataggcctacacgaagggacaagagcggcgtgtcatacaaaatgactaagtgttaaccatgcatattgcgcggcatggaacagaaggcgcgcaggcgcggcaacgcaatccgggcagcagtgacagtggccacggccgcggcgatggtgggcgtgctggccccggccgccggcgccgatccgctgccgggcggactgggaccctgcctcggcagctcctgcccgcccagctggaacgaccccaacaacggcccggtcgagtacttcgacagcaatatcaacgtctacgtcggtggcgacttcctggtccgggaggcggcggccgaggcggaggggaaggtcgtcaccctcggccggttcgacatggacaagcgggacggggtctcgcagatctacaacgtcggcatcgcgggcgtcggttcgcgggtgccgccgccggacggctccgactacctgacggcgggcggggacgtgaccatcgccgacggcgagcgtctgctcgccgaggagggcacgcactccggccgtgtcgcgtacgcgggtgacctcacgggcacggtgaaccccaccaccgccccgcgcttcgacgaggatgcggccgccccgtacaccgagctgcgcccgcagctcaccgaggcgagccactgctacgcgtacgacggcgacgagcaccgcgaggcgacgggcacgtgggtgaagaccggcgacgtcatgacgttcaccggtgacggctcgtccgcgatccagatcttcgacgtggacgcggacctggagtcggaagcgggcggcaacacggggttcgtgttcaacggcatccccgagggtgcgaccgtcctcgtcaacgtctacggctccacccgcagcgtcgccacgttcatgggctcgttccccaacgagggcctgcgcgagaacctgctgtggaacttcccggacgccaccgacctgtccctgaccggtccggcccagttcgagggcagcgtgctggtgggccagccgacgagcagcaccgtgctcagcatgagcggcaccaacggccgtttctacacggcgggttcgctcacccacacctcggcgggcgcgtcgggcggacaggagatccacgcgtaccccttcgacggcgacctgcctacctgcacgcccgacc

SEQ ID NO: 4378 - DNA, 1102 bp, Unknown
  Kingdom: Bacteria, Phylum: Actinobacteria, Class: Actinobacteria, Order: Streptomycetales, Family: Streptomycetaceae, Genus: Streptomyces
gtcgtccaccgcttgcggctcggcgcggcgctggggatcctcatcgccgggaccgcggtcaccctcgccaccccacccctcctgggctccatcgtcgacgcggtcgccgaaggctccgggaccggccgggtgaccacgctcggcgtcgccctgctggtcgtcgcggccaccggcgccgccctcgccctcctgggtgggcgggtgctggtcgcagtggtccaggacgtcctggcggcactgcgcgaggacgtgttcacgaccgcgatccggctgcccgtcgacctggtggagtcgtcggacagttcggacgtggtctcccgtgtgacccacgacgtcgaggcgatctcggaggccgcgtccgacgtcctgcccgatgtgacgggagcggccttcaccatcggtctgagcctcgtcgggctcgcggtcctcgacccccgcctcgccctggccggcctggtctgcctgcccgtccacgtcctggccacccgccgcttcctcgcccgcacccaccaggtgtacggggacatccgcaggctggagtccgcacgcggacagagcgtcatcgaggcggtgcacggggcggagaccattcgcgcgtacggaacccagggccggcacctggccgaggtgtccgaccggggcgagcgggccatcgaccggcagcgcgacggcgtacggctgcgcaacagcttcacggggtggctcaacgcggcggagttcctcggcctggccgccgtcctcgcgaccgggtacgcgctgctcggcgcgggggcgatctcgctcggctcggccaccgccgccgccctctacttccaccgcctgttcggaccggtgggcgcgctcctgggcagcctggacgacatccagcgcgcgacggtgggactggcccgcctggtcgggatcaccgacctcgcgggccaccatgccggcagggcggccgtgccgcgcccggcgcgcgccccgggtcccccggagatcgaggtgcggaacgtctcgttctcgtacgacgggctgcgccccgcgctcagcgaggtgaccctgaccgtgccggcgggcggcagtgtcgcgctcgtgggcgcgagcggctcgggcaagtccaccc

SEQ ID NO: 4379 - DNA, 1405 bp, Unknown
  Kingdom: Bacteria, Phylum: Actinobacteria, Class: Actinobacteria, Order: Streptomycetales, Family: Streptomycetaceae, Genus: Streptomyces
gacccggggtccgcgcacgtcggcgtggacgcaccgcgccgcaccacgtgggccgcgcagacggagcgcctgcgcgccgtggcgacgaccgagcccggccggctccagatcatcggagccgtcctggccctgctggtcgtggcgttcggcgcggtgaccaccctggagatctcgtcgcgggcctcgtccgccgacgacgtggtcagccgcagtcagccgctcagcgccgacgcggcggacatctaccgcttcctggcggacgcggacacgacggcggccagtgggttcctcgcgggcgcacaggagcccgaggccgtgcacgagcagtatcggaaggacatcgaggaggcggcccggctgctggtgaaggcctccgggagcaccgagtccgacagcgcgtccagccgtgagatagccaccctcaacaagctgctcccggtctacacgggcctgatcgagcgcgcccgcgccaacaaccgccagggcctgccgctgggcggtgcctatctccggtacgcgaaccagaagatgaccggcgagatgctgccggccgccgagcggctgtacgcggcggagacgggccggctggagacggactccgccgacgcccggcagtggcccctcctgtcgctgggtgccgggattctggtgctcggcgcgctggcgtggatgcagcggcgcacctaccgccggacgaaccgggtgctgaaccacgggctgctggcggcgacggcggccgcctcggtggtggtgctctggctggccgtggggcacgcggtggcccgtgcggagctgcggtcggcgatggtgcacggccaggcgtccctggatgtgctcaacgacgcgcggatcaactccctgaaggcgcgcgccaacgagaacctcaccctggtggcgcgcggcgctgtgctgacccccgacggctccgccgaccagtacgaggcggactacgccacggggatgaaggcgttgaaggcccagttggagaaggccggtcggctcgcggacgacgcgagcgggaacgcgccggtggccgacgcgaccgagggcgtggcccagtggcaggtccgccaccgcgaggcccgtgccacggacgaccagggcgactacgacgaggccctggagcaggtcatcgggaccgagaactccaccgggcagtccttccagcgggtggacgccgcgctggagaaggcgctcgcccatgagcagggcgagttcacctcggcggcgaaggacgggcgcggagccctgcggggcctgccgatcggcgccgcggcgctggcggtcatgggggccgccgccgtgatcgtcggggtcaaccgcaggctctcggagtaccggtgagaggggcagcgatgagcaggtcgaagaaccgtcccgcgcgcggcggcctgcgcggctgggg

SEQ ID NO: 4380 - DNA, 1798 bp, Unknown
  Kingdom: Bacteria, Phylum: Actinobacteria, Class: Actinobacteria, Order: Streptomycetales, Family: Streptomycetaceae, Genus: Streptomyces
cgtgctgacgttcggcggcgcgtactccaaccacctccgggccaccgcggcggccgggcggctgctgggatttcccaccgtcggcgtggtccgcggcgacgagctggcgcaccggccgctcaacccgtcgctcgcccggtgcgcggccgacggcatgcgactgcatttcgtggaccgtacgacgtaccgggcgaaggcctcctccgaggtcctggaggggctgctgagcctgttcggggacgtggaggtcatcccggagggcggcagcaacgtgctggccgcacaaggctgtacggcgctggggcgcgagctggccggggagtgcgatgtggcggccgtggcctgcgggaccggcggcaccctggccggactcgccgccggcctgaaccccgggcagcgggccctgggagtcccagtgctgcgcggcggcttcctcgggccggccgtggaacggctccagcacgaggcgttcggcggcccggccgggaactggtcgctggacgagcgcttcgccttcggcggctacgcccgctccaccccggagctggaggccttcgccgcggacttcgaggaccggcacgggctgcccgtggaacgcgtgtacgtcgccaaactgctgttcgcgctgaccgcgctggccggggagggggcgttcgcgccgggagcccgggtgagcgccgtgatcaccggctcccccgacgcaccaccccttcaggattcgtccgtctcccggtaggccgccgcctcctccaggtccagccggcgcaacagggtgcgcatcatctcgtcgtcgatccgccgctcgtcccggagccggacgaagacctcgcgctcggcctcgatcatctccctcgacagccgccggtaggtgtcgtccgccgactccccggtgaccgggtcggcggctcccaggcgctcccacacggcgttgcgacggcgttccagcacactgcgcagccggtccgccaacggtggcggcaggctgctgtgcgggtcggcgagcaactggtccaggcgggcctcggccgcctcggacgcctcgctctgggcctgcgcctcgatgagcgtgacggtctgcgggtcggggcccggcagcttcaggacgcgcacgaggacggggagcgtcaggccctggatcgccagggtcccgatgacggtggtgaaggtcaggaacagcaccaggctgcgggccgggaagggttcgccgtcgtgcatgaccagcggaacggagaacgcgacggcgagcgagacgaccccgcgcatcccggcccagcccacgatcagcggcgcggtccagtcggtgcccggctcgcgttcccggacgcggcgcgagagccaccggggcagataggtggccgggtagacccagacgaagcggaccacgacgacggccaggaacacgatggccgcgtaaccgagcgcctcccacacgccgaacgagccgagccccttcaggacgaacggcagctggagcccgatcagggcgaacaccgcggactccaggatgaaggccaccatcttccagacggccgcctcctggagacgggtggcgaagtcgacctgccaggagcggtggcccaggtagagggcgacgacgaccacggcgagcacgccggaggcgtgcacccgctcggccgccgcgtacgccacgaaggggatcaggagggagagcgtgttctggaggagggcttccttcagatgcgtgcgcagccagtggagcggcaccatcagcagcaggccgacgccgaccccgccgaccgcggccagcaggaactcgccgatccccgcgccccagctc

SEQ ID NO: 4381 - DNA, 562 bp, Unknown
  Kingdom: Bacteria, Phylum: Actinobacteria, Class: Actinobacteria, Order: Streptomycetales, Family: Streptomycetaceae, Genus: Streptomyces
gtgcggggtcgctttggggggaggtcacggggcgatcatcgcaagaacgggagggccctctggtcagctcgccggaaaggacgctagcgtggaggcacctttgcacacgcgggagctcggagcaccgggctgagagggcgctgatcgccgtacatccgtacgggaaacgctgcgccgaccgccgaacctgttaccgggtaatgccggcgtagggagtaggtctcatgaccacagcggacgcacgcacgcctgcctcgaaacagaacgacggaacgccgaacggcacgacgccgggcgacggaacgcggaacgacgaggccgggaagtccatcggctggcacaaggggtacgtccagggctcgcgcccggacctccgggtgccggtccgacaggtgcacctcaccaacggcaaggacgtgacgttgtacgacacgtcggggccgtacaccgatccctccatcgacaccgatgtccgccgcggcctcgcgcccctgcgggagaactggatcatcgcccgcggcgacaccgaggagtacgcgggccggccggcccgcgtactcct

SEQ ID NO: 4382 - DNA, 510 bp, Unknown
  Kingdom: Bacteria, Phylum: Actinobacteria, Class: Actinobacteria, Order: Streptomycetales, Family: Streptomycetaceae, Genus: Streptomyces
gccggtgcgcgggcggtgccggacgggacgacgctggtggtgggcgagtaccacgcggtgccggacgtgccccgccgggtgctggtgacgggaggcgcgcggtcggggaagtcgctggaggcggagcagcgcatggagacgttcccggaggtggtgtacgtggcgaccggcggccgccgcgacggggacccggagtgggcggcccggatcggactgcaccgggagcgcaggcccggcgcctggcggaccgaggagacctgcgaggtcgcggagctgctgagggcggacgggccgccgctgctgatcgactgcctgtcgctgtggctgaccgacgcgatggaccgggttaacgcctgggaggacgaacgctggcacgacggcggcgaggcggcgttgcggggacgcgtcgtggagctggtcgccgcggtgcgcgggacccggcggcaggtggtgctggtgaccaacgaggtggggtcgggggtggtaccggcgacctcggcggggcggcgg

SEQ ID NO: 4383 - DNA, 759 bp, Unknown
  Kingdom: Bacteria, Phylum: Actinobacteria, Class: Actinobacteria, Order: Streptomycetales, Family: Streptomycetaceae, Genus: Streptomyces
tcgccgccgaggtgaccggcacggtggtcctggtcgccctggcctccctcaccgccgatccggaagcggacccggaagccgccgaggtggtggaccgggtggcgatggcaggtgacacggtcgaggtgcgctggacggaggacgggaagcggacgacgatcacgttcggcggcgcggcggtcacggtggtgcacggtcctccgggaaccgccgcctagcgctaggcgtccgtacggatcaccaccaccagcctccggggcccgtgcacgccctccacccgctccagctcgatgtcggacgtggcggacgggccgctgatcagcgtcgtcggccgttcgggcaccaggcgcgccaccgcctcgggcacgcccgcctcgacggcggagaggtccaccacgcagaggtgcagatcagggacgagggacagggcccggcggccctggccgggcgaaccgtccagaaagatcgtgccggtctcggcgcagccgacggccgatgccgtcaccaccgcgtccagggcgtcgagttgtgagggcgggacatcggcgtcgtcctgccgcacctcaccgtcgtaccgggcgagccagcgcgcgtccagcccggccggcacgccgatgcggcgaacgccgtgctccccgaggacgtcgccgacgacctcggcggtgcggccggccgtacaggggtgcacccgcgccttgtagtcgaggagccggtcggcgaacagggcgaggcgctcgtcgtcgggcagggcgcggccgg

SEQ ID NO: 4384 - DNA, 1589 bp, Unknown
  Kingdom: Bacteria, Phylum: Actinobacteria, Class: Actinobacteria, Order: Streptomycetales, Family: Streptomycetaceae, Genus: Streptomyces
gtccccgccaccacggcgccgcccgctccgggcccggacgccgtcaccccggtcaccggtcccgcctccgccccggtgacccggcgcgccggatcccggtggcgcacggtgctcgtcgtggtcgtcgccgccgccgtcctgggaggcggggccgggctgttcgcgatgaagtacggggagggctcggaggcccccggcggaaccggcggcggcacggccgccgacagcacaccgtccgcggagcggacctcaccggagcccgaggcctcctcggagggcgtaccggagatacccgacggctggcaccgggtcgacgacccggcggggttcagcctggtcgtgccggtggactggacccggcaggtccaggacggccagatcgactacacgccggacggcggtgcccaccggatccgcatcagcgtcgacccggccccggacttcgaccatccgtatctgcacatggagaacatggaggagcagctctccgagcggctgccgggctatcagcggatcgggatggagaagaacaccttccgcgaccggccgggcgccctctgggagttcacctggaacgagaccaaggaccaccccggaccccggcacgggatcgaccagatgtattacgggggttccggcggccccgagtacgcgctgtatctgacggccccgcaggagggctgggaggccagccgcgagaagttcgacatcatgctgcgcagttggagcgctccgaaaccccagcagtgagcagggcgcccggcgagcgcacgatgctccggcccggtcgcgagacggtcacggctccgcatccggtgaccacccccggtggtgcccggaccggcgcgtgaaccaggatggggtacatgacagatcacgggggatgggcgaacgagcccaccagctacggaatccagccgccgcagacaccgggcggtttcggagcgccgcttcccgcgcctccggcgcacattccgtccccgaccgtccacgcgagcgtcccggacagtgcggtgaaccggctggtcggcgggcgctaccggctgctcgcccggctcgggcacggcggtatgggcacggtgtggcgcgcccacgacgaggtcgtcgaccgggaggtggccgtcaaggaaccacgcgtaccggaacacctgggcgagcgcgagcacagcatggtgcaccaacgcatgcagcgcgaggcgcgggccgccgcccggatcgaccacccctccgtcgtgaccgtccatgatgtggtcgtcgaggacggcaagccgtggatcgtcatggaactggtgcgcggcccgtcgctcggcgaccgcctccaggaaggcaccctggacccccgtgaggcggcccggatcggcctcgccgtcctcgacgcgctgatggccgcccacgcgctcggcatcctgcaccgggacgtcaagccggacaacgtcatgctcggcaccggcgaccgggtcgtcctcaccgacttcgggatcgcccaggtcgagggcgagcagcagctcaccgagaccggcgcgttcgtcggttcgcccgagtacatctcaccggagcgggtcctcgggcagcgccccggaccggagtcg

SEQ ID NO: 4385 - DNA, 1188 bp, Unknown
  Kingdom: Bacteria, Phylum: Actinobacteria, Class: Actinobacteria, Order: Streptomycetales, Family: Streptomycetaceae, Genus: Streptomyces
atcaccgcacccttgccgaatttccgctcgatctgcgcgagcgcggtgtccagcgccttctcctggtcggttcctgccatgagctttcacccggtccgattgagtggcacgcagcacgtcggagaacgtgagcgtctactgccgacaacggacgcgtcgaagatcccgaaagcgaacattcgatcgaatttcgtgtccagtgaaaggtatcaaaccgagggaagcgggacggatgacgcaccgggccgctccggacgcagaccgcgccgcccgcttcccacctgtcgccggaggcaggagccatgccgagctgctcggattcgccctccgccctgcgagctccaccgatgtctcacgaggtccttcgcgagagcgcggcggcgccaccaccgagcagtgggcggcgccaccaccgagcagtgggcggcggccgaccggctcgaccccggcgcgctcgatgccgaaggccgttggcgactccagttccgcgcgttcgtgatccgcagcgaccagggcgtgacgctggtcgacgcgggggatcggccccgccgacagcccggcggcctcgtgggctcccgtgggctgggccgtcgtgggcggcgagcaggtgcggccgtagtgtgtggaaagtccgggtgccgagcggcccggcccgcgcggacccgcgtcggcatactgggttgtatggacagggtgacgtcaggctacggagtacgggaacggctcggccggattctgttctcccgggtggcgggacccgacggcccggagaaccgggcccgtattcacggaacccccggcccccgctggttcggcccggaccggccggtgcgccgggtgcacggggacgcgtccatgttcatcggcggcctgcgcgccctgctcctccagtcgctgcaccccctggcgatggccgccgtcgcgggccactcgggcttccggggcgatccgtgggggcggctccagcggaccagcacgttcctggcggtgaccacgttcgccactgccgagcacgcccaggaagcggtcgaccgtgtacggtccgtgcacgagggggtgcgcggaatcgcgccctccggcgagccgtaccacgcggccgacccgcatctgttgtgctgggtgcacatcgccgaggtggacagcttcctccgcgcccaccagcggtacggggcgcggaggaagctgtcc

SEQ ID NO: 4386 - DNA, 1556 bp, Unknown
  Kingdom: Bacteria, Phylum: Actinobacteria, Class: Actinobacteria, Order: Streptomycetales, Family: Streptomycetaceae, Genus: Streptomyces
gtgccgggccgcctccggcgtggcggcgaggtcccggcccgcctccgcgagcagcgcctcggcccgctcggtcagcgccgcgaaccgggcctccgacgccgcctcctcggcggccagttcggcctcggccgccttgaggcgctccgcgtgctcctgctcctggtgggccagcacgctcgccgtacggtcccgggtctccgccatcgcggaagcggccgccgcacgcacctcctcggcgtcctgccgggccgcggcgagcaggccctccgcctcccggaccgcccccgccaccagctcgtcggccgcccggtccgccgcagcacgcacctcgccggccgcctcgcgcgccgcgtccccggccgcccggcccgccgcctaggccgcgtcccgcagcgcctggcccgcctcgaccgcatcggcgtgcagggcctccgcctcgctctcggccagcgccaggatccgctgcgcccgctcccccagctccgcgtagtcctgtacgggcagcgtcgcgacggtctccgccagccgggcggactcggcgagaagctcctccacccggcgcgtcagccgcgcgagctcgtcgagcgctccatcccgctcggcgatcagggcggccgtcgcccggtccacctgctccggacggtagccacgtccccgcaccccgacgacgtcgtacgcggacaccggtccagcactcatccctgaaacctctctccgacccgccgacacgctctgccacgctccgacacccgtaatacgtcaaggatgcggcaattggtgccggaagtcggaatcgatcagcaccattcaggccggaagcgaccggcatcacagacccgggcgaaccggtgatcatcggccgggtaccaggcacacgacgaggcgcccggacccgggaagggtccgggcgcctcgtacgcgctcgtcgctcagccctgcgtacggctcagatcaggccgtcccacatctgctccagcagcaccgaccaccagctctccggcgacgccagcgccgccgggtccagcgccaccagctgggcctggaagtcgacggtccagcggcccgcctgctccgggttcagcccgaaccgcagccgccacatccggcccagcagcgccatcgaccgcacgaactccggcagcccggtgttcacgaactgcggcggcaccgactgcccgccgggacccgcctccaccggtacggccacgatgttcgccgtcccgtactggacacagaccgcccggccgaagtccgtgcccatcaccagatacgaccccgcgtccggcgcgggctgcacctgccgctgcgccgccagctcggccagcgtcggcaccaccggctgccccggctgcgcccagaagaacggcccgaaatcggcggggagccccgcccacaccagggtgtgcgcgacgacctccggcaccccctgacgggacaccgcacgctggtcgaaccgcaggatgccctgtggaccgaacgcctgcgccagctcctcggccaccgcctccggcggcagcgcgggagcgggcggcatctgcggcagcggcgcccgcacc

SEQ ID NO: 4387 - DNA, 950 bp, Unknown
  Kingdom: Bacteria, Phylum: Actinobacteria, Class: Actinobacteria, Order: Streptomycetales, Family: Streptomycetaceae, Genus: Streptomyces
tcgccggacttcgcgggacgcgtccccgtgcccggccggtcaggctccggtggcggcgcccgtcgtgcccccggtccggccggtgtcgacgctccccgcttcgtcggcgatgcgctcgtggtggcggatcacttcggcgatgatgaagttcagcagcttctcggcgaacgccgggtccaggttggcgctctgtgccagttgccggagccgggcgatctggcgggtctcgcgggcggggtcggcgggcggcagcttgtggtccgccttgaggcggccgacctgctgggtggccttgaagcgctcggccagcatgtggacgacggcggcgtcgatgttgtcgatgctctcgcgcagccggttcagctcggcctggacggacgcgtcgatttcgctcgtactcatggtcagcgagcttagacggccgcgctcacgtggtgatcgtgggtgggttgtcggggtcgggtacccggtcgctccagccgccgggcacgctgcggccctgctgttcccggaagcggacgggagcggcgccgacgcggcgggcgaagagccgggagaagtaggcggggtcgtcgtagccgacgcggcgggccacggcggccaccgggaggtcggtggcggcgaggagttccttggcccggcccaggcggatgccgagcagatagtccttggggctgcagccggcgccgcgtcgtacggcggtgcgcagttcggcgggggtcatgccgtgccgggcggcgtgctcggcgacggtgagcggctggtacgcgtcccgggccagcgcctggagtaccgggtcgccgtcggggccgatgtcggcgcgggcgcggcgcagggtgaccaggagttcgtggacggcggccccggtctccacctccaggagggggttgccgcgccgggcggcgcgcacgatgcgtccgacggccgcgcggggggcggcggtgtcggag

SEQ ID NO: 4388 - DNA, 2914 bp, Unknown
  Kingdom: Bacteria, Phylum: Actinobacteria, Class: Actinobacteria, Order: Streptomycetales, Family: Streptomycetaceae, Genus: Streptomyces
cgcggacaccgtcaaccacgccattcgcgccgtggacctcacgtccggcgtgaccagcacgctcgccgggaccggccgccagtggtggcagggagccccggccagcggcccggcgcgcgaggtggacctctcctcgccgtgggacatcgcctggttcggcgaccggctgtggatcgccatggcgggcgtgcaccagctgtggacgtacgacccggagagcgcgaccgtacgcgtcgccgccgggaccaccaacgagggcctggtcgacgggccggccgccgaggcctggttcgcccagccgtccgggctcgccgtctccgccgacggtgagcggctctgggtcgccgactcggagacctcctcgctgcgctgggtcgaccgcgacgagcacgtccacaccgccgtcggcaccggcctcttcgacttcggccaccgcgacggggccgccgaccaggcactcctccagcatccgctcggcgtgaccgcgctgcccgacgggtccgtcgcgatcagcgacacgtacaaccacgcactgcgccggtacgacccggcctccggcgaggtcaccaccctggccaccgacgtccgcgagcccagcgacgcggtgctggtcgacggcgatctggtcgtcgtcgagtcggcccgccaccggctgacccggctccggctgccggaggaggcggtccgggtcgccgaccgggcgcaccggacccagcgggccgccaccgagatcgccccgggcgctctgcgcctcgacgtcgtcttccaggcgcccgcgggccagaagctggacacccgccacgggccctcgacccggctgctggtctccgcgaccccgcccgagctgctggcggagggctccggcgcggggacggacctcgggcgcgacctggtcctcgcggacggggtcaccgagggcgtgctgcacgtctccgcgatggcggcgtcctgcgacgacgacccggccaacgagtacccggcctgccatgtgcaccaacaggactggggcgtccccgtccgcgtgaccgcggagggaacgccccggctgccgctggtgctggcgggcatggacgagcagggctgagaggggggccggcaggcggcccgcccgggccgcctagaagtcgtcggcgccgttgcggagctcggtggtccagtagcccgtggcccacttctgcgggttgacggagaggccctcgggggcgggggacttcacgaccgccatgccgccgccgttggccttcagcgtgaccgtgaactccttcaccgtctcggtgctctccttgcggccgccctcggacatgcgcaccgcgacataggcggactgaccgggctccaggatcaccggggtctgcggcttgctcttggcgacgggcgggacgatgccccgcgcgttgtccaggaagtggatgtgcgggtattccttcatctcgcagccggcgccggaggtgttcttcgcgctcagcgtgaggtgggtgtagggcgggccgtcctgacgctcggcggtgatctgcagacccgccgccgtgcagaggggagcggaggccttggcggacgtgccgccggagtctccggagccgtcggcgctcttggtggtgcctgcggcggcctgcgcggttccggtggagctgccggtggatcccgtggtgccggtcccgaccgcgtcgtctgcggccttcggggacgcggcggcgacggtcgcggagtcgctcgccgccgagccctccgaccgggtgccggtgccgttgtcaccgcaggcggtgagcgtgagcgcgagggcggccgtggtcgcggcggccaggacggtggtgcggttgcggaaggtgcgcatggagattcccccgaagtgacggtgaggcgggcggacgtccggtcgagacgctcgcccttgagcggctgacgggaacgactctgcccgccgccgctcacgtatcgctgctgtcccgctgacgtcctgctgacgtcgggttcagcggtgccgcaccagaggtccgttccgctcagctctcctccgcgagccgtcgcagcgcctcgtcgtggcgccgccggaactccgtccgcgcggacacccgcaggagcgcctccagggcccgtacggcgccctcgtcgtagccggcccgttccgcctcctgcgcggcccggtccagcagccgtaccccgtcctcctcgtcccccagggccagttgcgcctcgccgcagacggccagcagcagcgagcggcgcgccgcctcctcgtgctcgggtcccaggtcgagcgcggtccgggcacaggcgagggcctcctgggggcggtgcgcggtgaggtgcatccgggcgaggtgctggagcgtgagcatctccgtgtgccggtcccccaccctgcgggtcagttcgagggcgcgcgcgcagttctccagtgcgacggggagctcgcccagctcggcctggacgaccgccaggttgaccagcgcggtcgcctcgcccagcgggtcgcccgcttcccgggcgagcacgggcgagcgctccagcagagccgcggcctcgtcggtgcggccctcctccgtcagcacccagcccagcagcgtgagcaccctcgactccgcgtacgcgtccttctcggcgcgtgccgactccagggccagttccagcagcggggaccagctgtcgcgtacccgccacaccatctgcggccactggagcaggatgatccgccaggcccggtcgtcgagtccggcctcccgggccgcgagggcgcccagcgcgaggtcctcgcgctcggtggccagccagcgcatcgcctccgcacggtcggcgaagtcctgtacggcgctgggccggcggaagtcctccgggagcacgaagcacggctcgccgccgggctccgccgtgtcggcggcggccagggcggtggcgatgcagtggtcgagcaccccga

SEQ ID NO: 4389 - DNA, 1165 bp, Unknown
  Kingdom: Bacteria, Phylum: Actinobacteria, Class: Actinobacteria, Order: Streptomycetales, Family: Streptomycetaceae, Genus: Streptomyces
cctcggtggccagcgagcgcagctcggcctcgtcggagcgcgcgttgcgtccacgcagcgcggcggctgcgacccgtccggggtcggtgtcgggaagatcgacggtgaggtcggtcagggtccgcagcaaagcggtcccgggtccgtcgttcgtgcctgctccggacgtggtggaggcagcggattcggtggctgaaaccggatcggcgggcgcgatggtcactgggctttccctcgctcggcaggggccggcggcaggcggggaagccgggcagcgcgaaacccggggcagggcagcacagctgacggcgtccaccggcctatccgcgagacccggacgtatggcgtccggttcggtcgagccggacgcgctgtcgacaggtcttcggacttgtgggtgtgcaaaagcacaccgatcacaccgttgcgggacagttccggattcgcaccggattcccctgcggcgacagcgaggtcgagcatacatgtgggggccgccggatgaagcggcccccacatgttgtgtcgcgacgattcaacgcgcctctcaggagggcgcctccagctccagccggaaggtcatgagccgtagtcccggcaccggttcccagtcccgttcgggggtccgtacgaagccgagccgacggtagatcctatgggccgcgagcatggccggctgtgtcgacagcaccagtgcccgcacgccgtcggcggaccgggcgcgctcgacgcacgcccgcacgagggcctctcccacaccccgtccgcgcccctcgcgggccacggccagcatccggaactcggcctcgtccggaccggcgatgtcgcgccacggggtgccgggtgcggcataggtcacaccgccgagcaccgccccgtgcgcgtcgagcgcgacgaggacctcggcctcggccgcacgttgtccgaccgcccgcagcttgagcagatacgggtcctgcgggccgtccagcagattctcgccgagatacgcctcggtgatgatctcgccgaggacggcgtactcgccggcctccgccgccctgatcgtcagatccatcagccactcgctcccacatcgttgttcggggcgccgtcgcccaccggcggcaggtccccccgctcggccggccgctgcccgggggcctcgcctgccggcggcagcacc

SEQ ID NO: 4390 - DNA, 2032 bp, Unknown
  Kingdom: Bacteria, Phylum: Actinobacteria, Class: Actinobacteria, Order: Streptomycetales, Family: Streptomycetaceae, Genus: Streptomyces
  misc_feature (1726)..(1727): n is a, c, g, or t
gcggcggccagcgcgcccgcggcctccccgtacggatcgtcgccggccgtccagctctggcggtacggggtgagggcccgccccgcccagcggtccgggtccggcggatagaggacggcggcgtgctcggcggtgacgacgcggtgggcggggtggcggggggtcagggcccgggtggagtggtaggcggaggccagggtgacctgccggacgccgaggtccgcgatccgggcggcggcgtccgggtccccgacgacgtcccacgggtagaggaacgcacccgccttcacgccgggtcccccgcccggcccaccggggaggggtgctcctgggacgcgtgcgccggggaggcgcgcttccgggatgcgtgctcctccagcagggcgcggccgctcgcgatgatctcgacgaggtccttgacgtgtgcggcgggcggttcggtgagcggggtgcggacctcgccgacgtccaggccctggagccggacaccggccttgaccagggagacggcgtatccgcggccctgggcgcgcagttcgacgagcggccggtagaagtggtcgagcagtccgtcgaccagcgcgtcgtccccggagcccagggcccggtagaaggcgagcgcgatgtccggggcgaaggcgaagacggcggaggagtagagggtgacgccgatgccccggtaggcggggccggtgagttcggcggtgggcagtccgttgaagtagaggaagtcgccgtcgggccggtgggtgcggaccgcgctgacgatgcgctgcatgaggtcgaggtcgccgtggccgtccttgagcccgatgatgccgggggtgcgggccagggcgacgaccgtctcgggggtgaagatcgcgttgtcgcgctggtagacgatcgtctccaggccggtggccgccgcgagcgccgcgtagtggttcagcagcccttcctggtcggcgacgacgaggtagggcggcatggcgaggaggccgtccgcgccggcctcctcggcggcccgcgcgtactggacggcgagcgccgtgccgtagccggctcccgcgaggacggggacctgtccggccgtctcctcgacggcggcggcgaccgcgaggcggaactcctcgggggtgagcgcgtggaactcgcccgtgccgcagcaggcgaagaccgcggcggctccggcgtcgatccccgcgcgcacatgggcgcggaagacggcgaggtcgacggtgccgtccggcccgaacgcggtcacggggaagaagagcggcccggcgacttcgctgagccgggcggcaaggggggctgaggtcacgggcgctccctgagcagatccaggcgtgcacaattatgatcggtgtccatatttctgaacaccgcaacgctaaggcagccttcgatggcaggtcaaggcggacgcgtgctcttgacgcacctcatctcccctccttagcttgtccacgcatgtgaatgccagacaggattgcgcacagcgcccgcgtacgccccgaggagacccccgtatgaccgctccccgtaccgtcctgctcaccggcgccgcaggcggcctcggcaccctgatgcgggggctgctgcccgcgtacggatacgacctgcggctgttcgacctggtcccggtggagggcgcgcccgaggcgatcaccgccgacctgaacaaccgggaggcgctgcgcgaggccgtgcgcggggtggacgcggtcatccacctggcggnnacgaggccgcccgcgaggagggcgtccggcgcatcgtgtccgcctcctccaaccacgtcatcggccacaccccgcgcccggccccgggcgatccgccgatccccctggacaccccgcgccgccccgacaccttctacgggctctcgaagtgcttcggcgaggacctggcgcagctctactgggaccggtacgggctggagacggtctcggtgcggatcgggtcctgcttccccgagcccacctcggtgcggatgctgtcggtctggatgagccccggcgacggcgcacggctgttccacgcggcc

SEQ ID NO: 4391 - DNA, 1093 bp, Unknown
  Kingdom: Bacteria, Phylum: Actinobacteria, Class: Actinobacteria, Order: Streptomycetales, Family: Streptomycetaceae, Genus: Streptomyces
ggcgtcgcgcggggcgagcacaccgagcgggacgcggcggtagttggaggcgtccatcgtcgtcagtgcccgggcggcggccccgaagtcgctcgcgccgcgtacggcggagcggagcgccgcgacgaaagccggacgcatgtcggtatccggaggcgtgtcggtatgcgatcgatgctgttcggccatggcctcagcatgccgtcgtatcaggtgaactcttgggatgcggcaggatcaaagcacgtaagcagtacaaaaaagcccacaagatcttcccaaacagaccgtcaagtctcctatagtgaccaagacttgcgcaggaattggcagctccagttgtgcgtgatcgcccacacccgtgccgaactgtcctgaattcgactggtccgtttcgcccggtccgtaccgcccccataccgtcccgcaccgtccgccaccgaggactccgattgcgcccctcacaccggcccaccgcactcgccctgctgatctcggcagccgcaaccggcacgctgaccctgtggggcgtcgccgcggcccccgacgcggtacggaccccgctggcctggtgcgcgggcgcagccgccgtgctgctgagcgtctgcgtggccgtcaccgtccacaccttggggaccgcgcggactctgcgcgccctgcgggccgccgacgcccagcggttcaccgccgagacctcgcgcctggtctccgcctccgccgtcgaggcccagcgcttcaccgcggagaccgcccggatcaagggcgccgcctccgccgagaccgcccgggtcgtcgctgacgcccgcgcggagaacgagcggatcgccgcggcagccgccgccgagcagggccgcctggccgtctccgtcgaccggctgaccgcccgtgccacccgtgccgagaccgagcgctccgccgccgtcgccgcctgtgccaacgcggcgggtcggatgcaggccctggccaccagcatgctggccgacctccgcgagatggagcaccggcactccgacgagtccgtcctcggggacctgctccacctggaccaccgcaccgcccaggcgggccgcctcgccgactccatcgccgtgct

SEQ ID NO: 4392 - DNA, 899 bp, Unknown
  Kingdom: Bacteria, Phylum: Actinobacteria, Class: Actinobacteria, Order: Streptomycetales, Family: Streptomycetaceae, Genus: Streptomyces
gccaggagctgttcgcgtccctcgtcgaaggggaggtaggacacggcgtcgaggacagcggcatcgtccccgcggacgtgggcccggtccgccatccgccgggccaccgccgcgacccggttgcggggcagcgcatccaggagccgggtgtcgacggtgaccgtcgaggctgcctcacccctgtcctcggtgaccgcctcgtggagtgcggcgcgacggccgggcggcagggcgcggaggatccggggccccgggcccgccgggtccggggaactgcggcccagttcgacgagaagggtgtcgggcagggcgcggacgaggcggcgcagccgggtcccgctgagtgcgttgagcacctgcgcgcagaagtccgccccgatggccaggcgggcgacccgggccgggtcggcggagacgagatggccgaggggaccgtgcagcacgaccgggagccgggtggggccgaaccgttcgaggaggtcgagcacccggtgcggaagcgcccgggtcgcggtggcgacgccccgggggtgtccgtacccgtgccaccaggcgtcccggcccgccgcggggaggcccgccagctcctcctcggcggagtccaggaccggaccggggtggtggtggccgagcgaggaccagcaggccgtcgagcgccgtagttcgggcagcagcgtcctgaccgtcgtggccgagcagccgggcagcagccgggccgcctcgatgtcgccgtgggtctcgcgcaccgcgaggaccaggcggtcggcgagcgcggtgcggcgtgcggcgacgatcgcccgcacgagatgacggcgcacggcggccggcgcgtcggcgaaggccctcccgtacgccctgtccggcaccccggctgtccgcgccgcccgcagggcgtgccc

SEQ ID NO: 4393 - DNA, 635 bp, Unknown
  Kingdom: Bacteria, Phylum: Actinobacteria, Class: Actinobacteria, Order: Streptomycetales, Family: Streptomycetaceae, Genus: Streptomyces
ggcgccgcggacgaccgtggccgacgacccgtcgaccacggtcgtccgcggcgccggacagatcctgagctcggtgctccgccatcggacggcgtcgtccgagcaatccggccggccgaggtgacgccgtacccgggaccgtccaggccgtatgcgtcccggatgcggtgtgtgctcgccacgctggtcctcaccgtcctcaccctggtcggcggcgccgcctcggagtccgccgtcgcctccgccccgacttcccggagcctcgcgcccgccgtcaccgtcgccgccccggaccccaccgcatcgcagacccaccgcgccggacatcacgccgggcgtgactcctggctacgcgcagagcacagcaccggacacgacttccggcaccgcgccggccacgccgccggagatgagcgcggggagccggaccacgcgagcggggccggggccgaccagggcccgggcgcggtggcgcaggccggacacgagcagcccagggcggcggccgatccggcgcaggctccccgggcgggcaccggccgggcctacctgctccttcacgcgccgccgccgccgcacgacgcgctgacgcccgctccggcggggccggccgagccgcgcggcggcgtccagca

SEQ ID NO: 4394 - DNA, 1217 bp, Unknown
  Kingdom: Bacteria, Phylum: Actinobacteria, Class: Actinobacteria, Order: Streptomycetales, Family: Streptomycetaceae, Genus: Streptomyces
ggtaggcgagggtacggagcagcgtgccgacgacgagccggagcaggacccagggcagggccttgcctcgtgcgttgacgagcatcgtgtagaccgcgcccgccttgtcgacgcggtgcgggctggcgaccgagcggccggcgcagtcgatgggacggcgttcgcgggcggaggcctcggcgtgccgcaggacggcgtccggggcgacgaggacccggtggcccgccaggtgggcgcgccagcacaggtccacgtcgtcgcgcatcagggggagcctgcggtcgaagccgccgagctcctcatagacgtcgcgacggatgagcatgccggcggaggagacggacaggacggtacggacctggtcgtgctggccctggtcctgctcgcggcggtccagaccggtccagcggcgtccgctgttggcgatggagacgccgacttcgaggagctgcttgcggtcgtaccagccgcgcagtttgggtccgacgatcgtggcgtgcttgtcggtgtcgacgacgcgcagcatctcggcgagcgcgtccggctcgggtgcggagtcgtcgtgcagcagccagagccactggaccggttcgccgtgcggcagttcgggaaggtcgtagttctcgtcgacccaggtccggccggccgggtcccagccgctgggacgcttgaggtacggcaggtcgtccggggtcaggactccggccgtgcgggccgcctcgtcgacggcggtgccgaagctcgtacggcgtgcgaggtgcaggacgcgttcgtcgccgagcgcctcggtgaccagccgggccgagtcgtcggcgctgccggtgtcggcggcgacgacgttctgtacgggacgttcctgcccgagcagcccggccagcacgtcgggcagccagcgggcgccgtcgtgggagacgagcacggcggtgacgacgtgccgggggaactctggggcggcggcggccgcgttcggcgccgccgagtggctgtgcacggacatcgaggtacgggccctccggccgggtccgggggcgtccccgggggctgcatcggtgtacacgcgcgcgccgtcggggcgttggcgcgtctcggacggggccccacactaacggtacggacaggtgacgagggtccgggcggccgaagggccgggcgcggacgtgccgacggcccgtcggccgagccccggggaaggggtcggtggacgggccgtcgggggt

SEQ ID NO: 4395 - DNA, 1002 bp, Unknown
  Kingdom: Bacteria, Phylum: Actinobacteria, Class: Actinobacteria, Order: Streptomycetales, Family: Streptomycetaceae, Genus: Streptomyces
gccgtacagcgccccgccctcggctcgctcgtcgcggccgtccccacggacccggagcagcaggccgccgccgaggcgggcctcgcctcggtcgacgaggaggcggtacggctgcgcaacgcggtgaaggcccacgacggcttcttcaccacgtactgcatcagcccctactcccgctacatcgcccgttggtgcgcccgccgcaacctcaccccgaaccaggtcaccaccgcctcgctgatcaccgcgctcatcgcggccggcagcgcggccaccgggacccggggcggctacgtcgccgcagggatcctgctcctggtctccttcgtcctggactgcaccgacgggcagctggcccgctactcgctgcagtactccacgatgggcgcctggctggacgccaccttcgaccgggccaaggagtacgcgtactacgccgggctcgccatcggcgccgtacgcggcggcgacgacgtatggaccctcgcgctcggcgcgatggtcctccaggcctgccgccacgtcgtggacttctcgttcaacgaggccaaccacgacgcggtcgccaacaccagtccgaccgccgccctctccgacaagctcgacaacgtcggctggacggtctgggtgcggcggatgatcgtgctgccgatcggtgagcgctgggccatgatcgccgtgctcaccgcgctcaccactccgcgcatcgtcttctacgccctgctcatcggctgctccctggccgcctgctacaccacggcgggccgcctgctgcgctcgctgacccgcagggccagccgcaccgaccgcgccgcgcaggccctcgcggacctcgccgactccggccccctcgcccgggccgtcgccgccgtcgcccccggactccggggagcgttcacggccccggcggtggccctgctcgggacgctggtcatgatcggcggggcgctcttcctcccgtacggcagcccgctgaccgtcgccgcggccgcggtgtacgtg

SEQ ID NO: 4396 - DNA, 608 bp, Unknown
  Kingdom: Bacteria, Phylum: Actinobacteria, Class: Actinobacteria, Order: Streptomycetales, Family: Streptomycetaceae, Genus: Streptomyces
ggcgatgcgccacgcggtgggccagtcggcccgcctccaccgcgtggcgcatcgccccggccatcagctccggctcctgggcccgggtcaccgccgaggcgagcatcacggcggcgcaccccagctccatcgcctgcgccgcgtccgaagcggtcccggcccccgcgtcgaggatcaccggcaccccggcccgctcgacgatcagctcgaagttgtgcgggttgcggatgccgagcccggagccgatgggggagccgagcggcatgatcgccgcgcaccccacgtcctccagcttccgggccaggaccgggtcgtcgttggtgtagggcagcacggtgaacccgtcgtcgaccaggacctccgccgcgtccagcagctcgatcggatcgggcagcagggtccgctcgtcggccaccacctccagcttcacccagtccgtgccgagcgcttccctggccagccgggcggtcagcaccgcctcgcccgcggtgaagcagcccgccgtgttcggcaggacctggatggagagccgctccagcaccgagagcaccgagccccgcacggtcgggtccagccggcgcatggcgaccgtggtcagctcggtgccg

SEQ ID NO: 4397 - DNA, 911 bp, Unknown
  Kingdom: Bacteria, Phylum: Actinobacteria, Class: Actinobacteria, Order: Streptomycetales, Family: Streptomycetaceae, Genus: Streptomyces
tgcgtacgccgttgaggtccacggagccggagtcgcggccaccggactcatgggtgccgtgcgtctcggcgggggcgggggccgcctggccctgctgcgcggggacctgctgctggggctggggcgcgccgtgctcgggagcggcgggctgcgccaccgccgtctgcgcggcgggctggccctgcgcgggagccggggcggcctgcgggtcgctccaggcgccctgggaggtcggcatcagcagaaggtcgtcgtcctcgggagtgtgctcggaggggtcgaggaaggtgtacgcgtccggggcggggatgcccggctgctccaccatgcctgcgttctccggcagtccctcgcccgggatctggccggtgtcagtcatgcgtaccccttgcccatcgtcagtgctccttcggcccttcgcccgggacgccgaaccacggcacgccggtgctcgtcatcaagaacgagcgggctcgccgcgcggcacgaaacgcccgcggggcttcctattctcgcggccgttcgccgccgcgacaggctgttctgccacggctcactgtggactgcgccacgttgcgcgtcccccgggtggtgccgtaccacagtgcggaccaaaacggtccacttttccggacattgacgaacgaagcgacgaacggccgggtgcggtacaacaatccgccagcctaccttccgcaccgggccgaacgggtcagggggcgaggtcggaacggcgtccggacagcaggaacacgaccgacctttcgcgctcggtccaggccgtggtgtccaggtcgacggactggagcagcgcgcactcgaccgtgtagccgtttccggtgagcgccccgccgagggcctcggcctcgtcgcgggtcgaggcgtgggtcacgatgcgttcggggcggcgg

SEQ ID NO: 4398 - DNA, 556 bp, Unknown
  Kingdom: Bacteria, Phylum: Actinobacteria, Class: Actinobacteria, Order: Streptomycetales, Family: Streptomycetaceae, Genus: Streptomyces
gtggaggaccgggagggcgacgggccgaaggagcaggggccggtcgagcgggccgaggcggcgacgaccgcgggctccccggcctcgctctcggacctcaccgcgctgatcggggaccggcagaagtgggtggagtcccacccgaaggacgccccgtccctggcgacgctcggcacggcctacgtggagtgggcgcggcgttcggcggacacggcgtactacgcccgcgccgaggagaccctgaagcgttcgctggaggcgcgggcgggcgagcgcgggaacggggaggcgtgggtgggcctggccgccctggccaacgcccggcacgacttcctcgcggcgaagcggtggggcgagaccgtgaagtcccagcagccgaaggcctggagggtctacccggtcctcatcgacgcgtacaccggtctcggcgaccagaaggcggcgaccgcggcgacggagaagttcggcgagctgcgcaagggagttccggcgctggcccgcaccgccgagctgtaccggggccggggctggcgcgaggacgcgctggccaccgccc

SEQ ID NO: 4399 - DNA, 2243 bp, Unknown
  Kingdom: Bacteria, Phylum: Actinobacteria, Class: Actinobacteria, Order: Streptomycetales, Family: Streptomycetaceae, Genus: Streptomyces
agccgtgccgggccagttcctcgaacgcggcccgcgcctcggcgagcctgccctgcgaggcggccagcagcatggtgtgccggaccggggtgatcaggtgctggggctgcggatcacgccggccgaagttcttccgtgccagggccagcagctcctctccctcggccaggtccccgcgcgcgacggccagttcggtgcggcgcagggcggcgagacccttcgccttgggagccagcgccaggcgggcggcggacacggcggcggcctcgctctgggtccagtgcccgagggagaacagggactgtgcctggttggcgtacacccaggccccggagtcggccaggccgtggctgtggcagatctcgatgccgtggtcggcggcggcgacggcctccagcgagcggcccatcgcttcgagcgaggagggcaggttgacgctgacccggccgaggaggttcatcaggtgcagcttctcggcgcggtcccggaccgcgtacatctcggcgaggccgtcctcgacgccacccgcgtccgcggtgagccagccccgggtgaggcgggcgtgcagctcgatgtactcgtcgccgacgagccgggcgtactccaccgcgcggtcgctgtcggcgagcgcctgcgggcccggctggtgcagcgcccgccaactggccacattggtcaggacgtcggcctgcacgggggacggcggcagtccgcgcaccagttcctgcgcggtggccagctcctcccagccgtcccccttgtccagcccctgcaccaggcgggcgcgctgcacccagaaccaggcctcgcgcagcgggtcggtctcggacgccaggacgcgcatcgccttcttggagatggccagggcgcgcttgcggtcgccgccgaagtgggcggcgacggtggcctcggccatcacgtccaggtagcgcagcggggtgttctccgggtcgcggccggaggccgggtagacctccgcgtagtcgaaggggcgcagggtggcgagcaccgcgtcggggacgtcgtcccagagctccatcgccctgtccagcagcctcagttgctcggagtaggcgtagcggcggcgggcctcgacggcggcccggagcacggcgggcagggccttggcggcgtcgtgggcggcgtaccagtagctggcgaggcgggtggcgcgttcgtcgtcccggacgagggaggggtcggcctccagggcttcggcgtaccggcggttgacgcgggtgcgttcaccgggcagcaggtcgtcgctgacggcctcgcggaccagggagtgccggaagcggtagccgtcggtgtcgggcgcatgttgcagcaggttggcgccgacggccgcgcgcagggccgcgtcgaggtcgtcctcggcgaggccggcgacagcggccagcagttcgtgttcgacgaaggagccgccctcggcgaccagccgggcgatccgctgggcgtgctcggggagcgcctccacgcggacgagcaggaggtcgcggagcgattccgtcaggccggagctgtcgccgcagcactccagggagcgggccagctcctcgacgaagaaggcgttgccgtcggaacggtcgaagatctcgtcgacgagtgcggcctcgggggtctcggcgaggatgccggcgagctggcggccgacctcgtcgtggctgaaccggtcgagttcgacgcgggtgacggtgcgcagccggtccagctcggcgaggagcggacgcagggggtggcggcggtggatgtcgtcggcgcggtaggtgccgacgaccatgaggtggccgctgcccagggtgcggaagagataggcgagcaggtgccgggtggaggcgtccgcccagtgcaggtcctccaggacgaggacgaccacgcgttcggcggagatccgctccagcagccgtacggtgagttcgaagaggcgggcgatgctgtgctcgtcggtcgcgtcccggtggacctcgcccagttcgggcaggagccgggccaactcgccctcctggccggcgcaggctgcggccatctcctcgggcagggcccggcgcagggcgcgcagggcggtggggaacggggcgaacggcagtccgtcggccccgatctctacgcaggacccgacggcgacgacggcgtcgcgccgttcggccgccgtgacgaaacgttcgaccaggcgggtcttgccgacgcctgcctcgccgccgatcagcagtgcctgcgggtcgccggacgcggcccgcgcg

SEQ ID NO: 4400 - DNA, 720 bp, Unknown
  Kingdom: Bacteria, Phylum: Actinobacteria, Class: Actinobacteria, Order: Streptomycetales, Family: Streptomycetaceae, Genus: Streptomyces
  misc_feature (284)..(348): n is a, c, g, or t
agagcgtgcgctccaccgtcgaggagtagaccatcaccaccgcggcgagtaccccgacggcgaccgcgatgacgaagccgaggagcgtctcgtacgtcgtcacccaggtgtgctgccagaggtacccggtcttcgaggtcaggacgtcgagcgtggcgccgggcgacggcacgaggtagggctcgatcagctcggcggccgcgatcacccaccagaccaccagggcggccagcagcagggcgaggggccgccagctctgctccgccgcgcgggcgaaccgctcnnnnnnnnnnnnnnnnnnnnnnnnnnnnnnnnnnnnnnnnnnnnnnnnnnnnnnnnnnnnnnnnngccgcgcgggcgaaccgctccccggccgtgggaccgtccctgcgggcgacccccgccacatcggcgggacgcttggccaacgcgctctggctcacggtgaactccctggacttcgggggcagttgtggagacctgtgcaatgctgcgaagctgcggaccctgacggtgaaggcgctttcagaaagcgctttctggtaaggtgccgccacgctaatgactgctccctcgcacggtcaataggtcgttccgaagtttcgggaccctgccaccaccgcacccctgggggtcgagttgagtgaacgggaaacaccggtccaccccgatacgcgacggcgggcctccaccgcccatgtgacgctcgacgcggtggcg

SEQ ID NO: 4401 - DNA, 901 bp, Unknown
  Kingdom: Bacteria, Phylum: Actinobacteria, Class: Actinobacteria, Order: Streptomycetales, Family: Streptomycetaceae, Genus: Streptomyces
gctcccgtacgccgaggactccggcggggtcgtccgggtggtccccgagcaccgggtagttggagtgcccgtgccgggcgatcagctcgacggcctcggcggcgagggcgtcccggcggacgaacgccacgtcggcgcgcggcaccatcacctcgcccaggttccgctcggagaactccagcgcgtggtcgatgagttcggccgtggtggccgggagttcaccctgctggcgggattctccgacgaggtggcccagctcctccagggtcgcaccgtggtggagctcctcgaccggttcgatgccgacgcggcgcagcaaccggttggcgacgccgtcgaagacgcggaccacggggccgacgatccgcaggtagacgagggtggaggaggcgagggacttcgccatgctctcgggcacggcgagggcgaggttcttgggggcgagttcgccgaggaccatctgaatgaccgtcgccaccacgaacgagagcaccacggagatgcccgagaccaggccgtcggagaggcccgtgccgctcagggcgggccgcaggagggcggagacggacggttccgcgaggaagccgacgacgagtcccgtgacggtgatgccgagctgcgcgccggacagcatgaaggagagccgctccagcaccttcacggcgcgggcggcccgcttgtccccggccgcggcctcccgggcgagggtcagccggtcggcggagacgtaggcgaactcctgggccacgaagtagccggtcccggcggtgaggacgaacacggccaggaggccgagcagggcggaggtcatcggccacccgccccgcgcgggaggcggcgggcggccctgcgcggggccgcgggtcggtgacggtgggggtcgggccccgaggggcccgga

SEQ ID NO: 4402 - DNA, 503 bp, Unknown
  Kingdom: Bacteria, Phylum: Actinobacteria, Class: Actinobacteria, Order: Streptomycetales, Family: Streptomycetaceae, Genus: Streptomyces
gcaccgaccggggccaggacttcctctacgtccgacggcccgacgtctacctgggcgcgtacctcggcaaccgggccaccaccatggcgcgcaccggcctttcgttcctgtggcacccggtggcaggcacggtcattcagtccctcaacgacaacgatcacggcgtgtgggccaccgtgctgcccggccaggtcccggacgccgacgggccgcaggccgggcagttcttcggcgggtccccctacgccttccgcttcgccacccccagcggttcggtcgtcacggatgtccgggtgagcgacgggctggtgcggcgatcggtgcgggcggtgtcctccgcgaccgaaacggtgccgctggtcctcaaggcgtccgaccgggtggtgttcaccaacgggaccaccgtgccgtggggcggctcggcctcggccaccgccaccggcctcgacctgcaccggggctccggtgtcgtgcggatccggtggggcgcggcgagggcggcg

SEQ ID NO: 4403 - DNA, 598 bp, Unknown
  Kingdom: Bacteria, Phylum: Actinobacteria, Class: Actinobacteria, Order: Streptomycetales, Family: Streptomycetaceae, Genus: Streptomyces
ccaggtggtcccgggcgaacgccttctcccgttcctcgcgcagctcgggcagcccgtgcgcgaggagggtgttggcgacccggcggtgcgcctcgaccagggcggcgaggtcgcgggcccggtcggggacggcccggccggtcacgatcagccggcggaccagggcgatccggccgaccgccgcggcggcgagcgggccgaagaggatctcgccgtgcgccaggtcctcctcgtaccgcagtccgtgccgccgggcggcctcgcggcgcagacagaaccccgtcaccagggcgtccctgacgacgagttcgggggcgtcggtgaagcgtgcgagggtgcgggagcgggtgtacagcccaccctgccaggacggctcccgttccttgcccccctcgtccgtgatccggctccagcggccggcgatcaggtcagcacggctggtctcacccgcctgccagagattgcggcaggcgtgccgctggaggcgttcaccggtggcgaggaccaggacgtaccggccgtccgccgcgtccaggcccgcgttgcgcagggctccggtggtacggacggccgggtcggcgcggacgaggcggacccg

SEQ ID NO: 4404 - DNA, 1586 bp, Unknown
  Kingdom: Bacteria, Phylum: Actinobacteria, Class: Actinobacteria, Order: Streptomycetales, Family: Streptomycetaceae, Genus: Streptomyces
ccggagccgaccccctcggcctcgcccgccgcgcagctgcgggcccgtgcgatgagcggaccggaggccgccgggccgctgcggactccggaggcatcgccgcaggtggggccggtttagccggggctcttcgggggctggtttgcgcaatgtgggtgagagtgcgtatggtggtagatcgtttgatcccattgcccggcgccgacacagaagagcgccgtgtggcgcgtactctcccttgccgtggctggaccgcattgaggcggtcgaaattgcgaatcacggagttatgggcgcgtgccgagactccggaaggtttcgcatttcgcatgtcaatttccagttctgaccacaccgtcatgcccgagaacgtcgacaacgccgagctcatcgagctcgtcgaggccgctgtgaccgaggcccccgccggcgcgaccgccccggccgccgagaccgtcgtcgccgagaagtccgtcgcggacttcatcaccgacgtacaggccgacacgcaggccgacgctcccgccgaggagatcgccgctcccgccgccgcgaccgcggactccgccgaggagatcgccgacgaggccgacgccgagccgaccatcaccttcggcgccctgggcctgcccgagggcatcgtccgcaagctcgcgcagaacggtgtgaccgcccccttcccgatccaggcggcgaccatcccggacgcgctggccggcaaggacatcctcggccgcggccgtacgggctccggcaagacgctctccttcggtctgccgctgctggcctcgctctccggtggcaccaccgagaagaagaagccgcgcggcatcatcctcaccccgacccgtgagctcgcgatgcaggtcgcggacgcgctgcagccgtacggcgacgtgctcggcctcaagatgaaggtcgtctgcggcggtacgtcgatgggcaaccagatctacgcgctggagcgcggtgtcgacgtcctcgtcgccaccccgggccggctgcgcgacatcatcaaccgcggcgcctgctccctggcgaacgtccaggtcgccgtcctcgacgaggccgaccagatgtccgacctgggcttcctgcccgaggtcaccgagctgctcgaccagatccccggtgggggtcagcggatgctcttctccgccaccatggagaacgagatcggcacgctggtcaagcgttacctctccaacccggtcacgcacgaggtcgacagcgcccagggcaacgtcacgaccatgtcgcaccacgtcctcgtcgtgaagccgaaggacaaggcgccggtcacggccgccatcgccgcccgcaagggccgcacgatcatcttcgtccgcacccagctgggcgcggaccgcatcgccgagcagctcatcgagtccggcgtgaaggccgacgcgctgcacggcggcatgacccagggcgcccgtacgcgggtcctggaggacttcaagaagggttacgtcaacgcgctcgtcgcgaccgacgtcgccgcccgcggtatccacgtcgacggcatcgacctggtcctgaacgtggacccggccggtgaccacaaggactacctgcaccgc

SEQ ID NO: 4405 - DNA, 1154 bp, Unknown
  Kingdom: Bacteria, Phylum: Actinobacteria, Class: Actinobacteria, Order: Streptomycetales, Family: Streptomycetaceae, Genus: Streptomyces
ttcggcggcaccaacgcccatgccgttctcgaacaggccccgcctccgccctcctcgaccgctccggcctcgtcgtcgccggctgtcgcgcgcgaagtcgcggtgggtgggccccacttgctgaccctgtcggcgcgcagtgcgggcgcgctgcgggacgcgactgcccggctcgccgcgcacctggaaagccgcccgcgtctgcgcgagggcgacgtctgccggaccgcgagcacgtcccgggacgagggaccccaccggctcgccctcatcgccgacggtgatctacgggaacagctcgccgccatcgccgccgacgggacggaagaagcgggcgggcagaccgggggcttcgttggttcccggccgcgcgtggtcttcctgttcccggggcagggctcgcagttccccggccgcgacggggcgctgtaccggacggcgcgagtgttccgggacacgttcgacgacgcctccgcgctcctcggtccggtgtgcggacggcccctgctggactgggcgctggatccggaggcggaccccgccgcgcaggccgcgacggaggtggcgcagccgctcctcgtcgcctccggagtggcgctcgcccgccagttgcgtacctggggcgtggagcccgacgcggtcgccgggcacagcgtcggggagatcaccgccgcctgtgtcagcgggatgctgacccttcgggaggcggtacggttcgcggccgaacgcggccgtctcatgggggcgttcaccgaacccggctccatgatcgccgtccgcgggggtgaggaggccgtcgccgcggcggtggcggggtccgaaggggcgctcgccgtggccgcgtacaacggtcccgggctccaggtcctctccggaggcgtccgtgccgtggagcgcgccgccgccggcctcgaagccctgggcatccccacccgtcgtctgcgggtctcccgggccttccactcaccgctgatgcacccggtcgccgaccggctcgccgacgcggcccgtgcgctgaccccgcaggtcccgtccgtccccctcatgagcaccgtcaccgccgagtggcagccggtcctcggcccggagtacctgcgtgaccacgccgagcgcccggtgctgttcggggcggccgtggaacgcctggcccggga

SEQ ID NO: 4406 - DNA, 1081 bp, Unknown
  Kingdom: Bacteria, Phylum: Actinobacteria, Class: Actinobacteria, Order: Streptomycetales, Family: Streptomycetaceae, Genus: Streptomyces
gtcgtacgagaacaccgcgccgaccgcctcgctgatccggcccttcacctcactggtccggccgatgtcggtgagcgcggtgttctcgtacgactacgcctcgcccgcccggtccgaccgtgccgcgagcacctatctgaccggccgggccgtccagcagcacaaggacatgctcgccgacgtacgggagcaggccccgaagcagaagctcgtcctgaccaccaccgtgaccgagagcggggtcgagttcctcgacggcgaccgcgcccggctgctgatcttcgccgaccagagcaacacccgtaccggcaaggacgaggagacgacgtacgcggcggccatgttcgccgtggacgccgtccgccgcggggacacctggctgatcgccgccatcgacacgttcacccgctgagccccggagaggggagtcccagatgaccttcaaccgcacggtgcgccgccggatcggcaccacggccaccgccgtcgccgcgatgaccgcgctcaccgcgtcccaggccccggggttcgcgccgtccgagccccggcaggggaaggcggcgtcgtcggacgacgtcgtgtggagcgaggtgccgggcgacgacgcctaccacaccgagttgccgccgctgcggtccccggagccgcccgcgcccctgaagcccgggacgaagcccgatccgctcgtggcccgcgcgtggtccgaggcgggcattccggcgaccgtgctcgccgcctaccgcaaggcggagagcgcggtgcgccgcggcgacccgggctgccggctgccgtggcaactgctcgcggcgatcggcaaggtcgagtccggccaggcctccggtggacgggtcgacgcccgcgggacgacgctcacccccatcctcggccccgcgctcgacgggaggggcttcgccctgatccgggacaccgacggcggggcgtacgacggcgaccgcgcctacgaccgggccgtcgggccgatgcagttcatcccctcgacctgggcgacctggggcgcggacggcaacggcgacggccgccgggacccgaacaacatctacgacgcggcgctcgccgccgg

SEQ ID NO: 4407 - DNA, 917 bp, Unknown
  Kingdom: Bacteria, Phylum: Actinobacteria, Class: Actinobacteria, Order: Streptomycetales, Family: Streptomycetaceae, Genus: Streptomyces
ctgcacgcgcgggcggcggccgacaacctcggctcgcgccgggtgctggagaagtgcggcttcgtggtgaccggcgaggaccgcgggttcgcccgggcccggggcgaggcgatcgacgaggtcctggtcacgctgcacggctgagaggctgtccggtggcctcggcccgggcgtgaccggctctcccccgcgcggcggagacggatcgtcgtccggcaggacgtgcggggcccgacggcacggaagcctggatgccatgacagcgaaccggccccccgccgtacccccgcccgcctcgccgcaccgtaccgggacacccgggacgtccccggaccgcgacgcaccgaccgaggcgtccccgtaccgcgtcggccgggcgcgggccgtgctccgggtggtcgccgtggtggcctgtcttccctacatcggcctcaagacggcctggatagcgggcagtcggctcggcatcccggaaggcagtccgctgctggacggcggcaccgtgctgcgcgtcgccaacggagccacggtgctgatggactgcgccgtcatcgtcctcgcgctgctgctcacccggccctggggcaagcgggttcccgcctggctgctggtgctgccgatgtgggtggcgagcggtctgctgctgccgatcatgacggccttcccggtccagctggctgtcaggatcctcggcgatggcggcggccggccggtcggcgaggggaactccgagcccttcctggacccgtgggtcttcggcgtcgtctacggcggcttcatcgtccagggcctcgccctcggcgtcctcttcgcgttgtacgccagggagcgctggggccgtctgtggcagggtcggctgcgggatctgccggggagtccgaccgcgcccgccctgcgcgcgaccgccgtcgccgccg

SEQ ID NO: 4408 - DNA, 538 bp, Unknown
  Kingdom: Bacteria, Phylum: Actinobacteria, Class: Actinobacteria, Order: Streptomycetales, Family: Streptomycetaceae, Genus: Streptomyces
ggacgagccggagacgggcgcggtggtgctggaactctgcgagccgcccgcacggcgggactgggtctgagcgccaggccggccgggcggcgaaccgccgaccggccggtcagtcgagccggctgagcagctcggcggccaacggggcggaggaggccgggttctgacccgtgatcaggttccggtcggtgatgacgaacggcgcccagggctcgccctcctggaagtccgcgcccagtgccaccagccggtcctgaagcagccacttcgccttgtccgcgaagcccgcctgggtctcctcggtgttggtgaatcccgtcagccgatacccggcgaaggcgttcgcgccgtcgggtccggtcgcggccagcagcgccgccgggccgtggcagaccacgccgagcggcttgcccgaagccagtacccgggcgagcagccgcccggagacggggtccaccgcgaggtcctccatcggcccgtggccgccggggtagaagacggcgtcgtacgcgtccgggtccacgtcctccagggcgac

SEQ ID NO: 4409 - DNA, 575 bp, Unknown
  Kingdom: Bacteria, Phylum: Actinobacteria, Class: Actinobacteria, Order: Streptomycetales, Family: Streptomycetaceae, Genus: Streptomyces
gtcgtcgaagccgaccaccgacacatcgcgcccggcggtgcgtccggcgtccttggcaccccggcagatcccgatcgcgcacatgtcgttgatggcgacgaacgcggtgggcgggcggggtccggagagcagctcgcgggccgcgttgcggcccagctcggccgcgtccttgtcgccgaactcggtggtgtccgccccgggccagaccgtggcgtcggccgggtcgagcccggcctcctccagtgcggcgcggaagccccggagccgctcgcggcggttgacgctgttgaccgatccggagacgaaggcgagtcttcggtgaccgagttcgagcagatggcgggtggccagctccgcccccatggcgttgtccacgctgatgctcgccagtgacggcgggtcgcccgcctgggccgtgcggtcgaaggcgaccatcttcagacccctgctgagcagcggctcgacatgttcgagcgagggcagcgaggagcagagcaccacgccgctgaccccgtccgccaacagctcctcgccgtacttgagctcccgggcgggatcgcgctcactgttgcaga

SEQ ID NO: 4410 - DNA, 545 bp, Unknown
  Kingdom: Bacteria, Phylum: Actinobacteria, Class: Actinobacteria, Order: Streptomycetales, Family: Streptomycetaceae, Genus: Streptomyces
tccgggacgatcgccctggtccgcgctccgctgccgaacgcccggcaccgcgcggaggtcgccaagctgatggtccggccgtccgcgcgcggtcagggactcggcggggcgctgctgtccgccgtcgagacctacgccgcgaccgagggcatcacgctgctgatcctggacaccgagagcggcagcctggccgagcaggtctaccgcaaggcgggctggacgaaggtcgggagcgtaccgggatacgcggcggatcccgcgggcagcctcaagccgaccactttctactacaaggagctcgccgttccgtgagcggtgggcggcacaatgggcaccaccacgcaatgatcagggagagtttcatgacgctgcacgacattccgctgcgcaccctcacgggcgagccgaccacgctgggcgcgtacagcggccgggccgtcctcgtggtgaacgtggcctccaagtgcggactcactccgcagtacgagggcctggagcggctgcagcagaactacggggaccggggcctgaccgtgctcggcgtc

SEQ ID NO: 4411 - DNA, 1177 bp, Unknown
  Kingdom: Bacteria, Phylum: Actinobacteria, Class: Actinobacteria, Order: Streptomycetales, Family: Streptomycetaceae, Genus: Streptomyces
gcccgggcctgggccatcggcctggtcggcgggctggagccgcatctgcggatcgccctggcctgctggctgcgccaccacgcccgaacagcccccgccgcggccgaactgcacgtccaccgcaccaccctggccggctggctcacccagtgcgccgaacacctcgcgcggaacctcgccgacgccaccgtgcgcgccgagatccacctcgcgctgaaggtcacccggaccggtcccgaggacccggcggccctcccccggcgcggcggccgcacctaccgccgcctgtgaccggaatcgagcgggcggccggtctcaggacggcgcctggccggtctcgaagcggctgacgcggtcgccggcgaccgtgaagacccagcgggtccgcatcgtgccccaggtgtcgttggtgtagtcgacgacgagcgtgcggccgtcgtcggaggcgtccacgacctccatgcggccgttggccttcggggagaagatctccgtctccgtccaggccgccaggtcccgctcgctgccgtcgtcggacatggtggcgtcctcggtgaggacatcgccgaagaaggcgttcctgtcgcccgcgttcaccgtggcgatgaacttctccaccaccgggtcgctgatcgatgaggccatcgtgttcctcctccgcgcgtccgggaaccgacgtcccggagatcctcaccgagtctctgtcggcacgcccgccaccgcatgtcgggcgtgccggaccgcgtggcccccgtggcgccccggcccggggaggcggatcaggcgggcggccccccgacccggccgaggaagagatcccggcccggacacgtcgtgtgcgcgggccacagcgcgtggaccgggacctggacgggcgggtccaggtcgacgacgtgggccgcgccgcccgccgccggacccgggggcgtcgtgacgaaggcgatgcggccggtcgcggtgacggccgtgacgggcggggtgccctggaccgggttgcgcagggtgtccggttcgacgcccgcccgacggcacaggccgatcaggagatccgtgtacgcggacgagcccggctccccccacaccgtgagcggctcgccgcgcaggtcgcccagggccacggaggaccgggcggcgagcgggtgtccggcgggtacggcgacccgcaaccggtgttccg

SEQ ID NO: 4412 - DNA, 705 bp, Unknown
  Kingdom: Bacteria, Phylum: Actinobacteria, Class: Actinobacteria, Order: Streptomycetales, Family: Streptomycetaceae, Genus: Streptomyces
tccggggcgcgccccggagatggcgagcgccacgtcctccggcgggtctgtcaggtggagggcggtcgtgtcggcgatccgaggttcggccccgtccgggaaggtgagcgtctccggggcgcgcttcggccccttgaagggcacggtgaggtcgtccggcagccgccagctcagcccgtcccgcatggcgaaagccgcggaatgcacctggctgcgctgccagcggggagtggcggcgggcggggtgcccggcccgggggtcgtcggtgccggggtcttcggggcctcggcgacccgctccacgcgcacccggtagtggacgtcgtccagatgcaggtgggacccctcccaggcccggtgctcgctctggtggtacgcctgggtgccctgggtgtagtcggtcctacgggtccagcccagcgagacgccgatcttcagcatccagttgagcggcggccccatgcccagcgcggcggcgacccgacggccgacaccgacgctgcgcccgccgcccgtacccgcctggccgcgccgcatggtgtccagccggacggtcgcgccgccgacctcggagaaacgctcccagcggtggtacgggacggcctcgacgaccatctcgtggccgaccccggacctctcccggccgacgaagcgggcgccgcgcggggcggtgaacgcgccgggctggtccttcagcaggcgcag

SEQ ID NO: 4413 - DNA, 579 bp, Unknown
  Kingdom: Bacteria, Phylum: Actinobacteria, Class: Actinobacteria, Order: Streptomycetales, Family: Streptomycetaceae, Genus: Streptomyces
gggcgaggaggtcccgggggtggtgacgggtacggcggtggacgcgccgccggacgggtggcgcgggcgcgggcggagtcgcggaccacaggctccaggccgtccgcagcggggcgcggacgaacagcaccaggcagcggcccagccgggcgagggcgacctcgccgcgccacagccaccagccgcagatcagtccggccaccgcgtgggcggcggccatgccgagggtgaacaccgtcccgtcgaaggcggccagaagccccatcaggtccgacgggccgccgatcgggacctcgtgcgcggaatggttcatcgcacccgacgcacctcgcccgccgcccgagtggtgcgcgccgaagccggacggcagccaggatccggcgaaggcgaagaaggcgtgcagccccaactggcccaggacatgggccgtcacggtctccggtgcgctccgctcccgcgcggcgagccaccaccccgcaccgcacaccggcagcaacgcggcggcctggacgagcaggggcagggtagcgccggacatcagcgcgtggccgagtccggacacgcgctgatgtccggcgc

SEQ ID NO: 4414 - DNA, 2800 bp, Unknown
  Kingdom: Bacteria, Phylum: Actinobacteria, Class: Actinobacteria, Order: Streptomycetales, Family: Streptomycetaceae, Genus: Streptomyces
gtctgcgcgtcgtccgcgttggggccgatcaccgccaccgtacgggggacgccggaggcgagaggcctgccacggccctcctcgtccgccgtcaggccgcccgcgaacggcagcgtgccgtcgctggtcagcaggacgagcgagcggcgggccgcctccaggttcagcacggcgtgcgccccgctgccgatgacctcggcctgccgggcagcgtcggggtggcgcgggttctcgaagaggcccagctcgaacttgagcgtcaggatgcggcgtacggcggcgtcgatctcggactccgccaacgccccctgtgccacggcctcctgggcacccgcgaagaagttcgacgtggtcatcaccatgtcgttgcccgcgcggaccgcagccgccgacgcctgcgcgtagtcggcgtagaccttctgctcccagaccatgcggccgacgttgtcccagtcggtgaccagggtcccggtgtaaccccactcgccgcgcagcacctcgttgagcagccagttgttcacggtgatcggcacgccgtccatcgactggtagccgagcatgaacgtgcggcagccttccttggcgacccgctcgaacggcgggaggaaccaggagcgcagcttgcgccgcgagatgtccgcctcgctggcgtcccggccgccctgggtctcggagtacccggcgaagtgcttggcgcaggccaggatcgcggtcgggtcgtcgaggccgtcaccctgatagccgcgcaccatcgcggaggccagctcgccgatcaggaacgggtcctcgccgaaggtctcgctcacccggccccaccgcaggtcccgggtgatgcagagcaccggcgagaacgtccagtgcaccccggtcgccgcgacctcgaccgccgtcgcccgcgcgatccgttccaccagctccgggtcccaggtggcggccatcccgagctgcgtcgggtagatcgtggccccctcccagaaggagtgcccgtggatgcagtcctccgcgacgagcagcgggatgcgcagccgggtcttcccggtgagcacggcggcctcgcgcacccgctccggcgaggcgtgcaggatcgagcccgcgtgcaggtcctcgacgaggtgccgcaccccctccttggcgttgagctggagcatctggccgaccttctcgggcagcgtcatgcgccccaggaggtcggcgacccgctccgcgacgggcagcgcggggtcgaggtacggcggctggaggcccacaggagttcctttcacgaaaagcactccgcagtaccgtacgctcaatcccgaccgcttggtaagtattggcagatccaggattcggtcctgtgagaatctgggccggagcggcggtgcgagaggggtgtccgatgccgatgacagcgggtgatggcgcgtgacttccggggcgcggcgcggctacgccaagggccgggccaagcggaccgagatcctcgaccaggcgatggccctgttcggcgaggccggctaccggggcgcgtcgctccgggtgatcgcgacccgctgcggcatctcccacccgggcctcctgcaccacttcccgacgaaggaggccctgctcctcgccgtgctccagcaccgcgacgacgtggacgacgagtggctggccctgggtgtgacgcggggcgtcgaccatctgcgccggctgaccgacctcgcggagctgaacgcgaagcggcgcgggatcgtcgagctgttctcggtggtcgcggcggaggccacgtcccccgaccatccggctcacgcctacttcgaggcgcgctaccgcacctcggtcgccaacaccgaaatggcctaccgccaggcccgggaggcgggcgaactccgggacgacgtcgacccgtcggccgccgcgcagcagctcatcgcgctgatggacgggctccagatccagtggctgatcagcgactgcgtgacggacatggcgggcgtgctgcgggcccacgtccaggcgcaggtgaccgtgcggttctgaggagctcggcgcgccccgcggccaggggtccccgccgcgctcgcggccggaccggcccccgcacccctcagccgtcgaggaactccgcgcaccgcaacggccccagcaccggaccctcccccgggcggatcgtcacctccacgtcgtccgcccgcacctccgcctcacgcacggactggaagctggcgagcgtgcagaccagctgacccgtgacctggtcccgcgcctccgcccagtacgggtcctccagctccacggtgacgcgggttccgtccccggtcacggtgtagccggcgggcgcgtggagcagcgtggtcagcccctcgcgccgctcggcgtccgtcggcccctgggagagcagcttcatcaccgcgtcgaggctgctgatgtcccggtcgagcacgggcacggcccgcagcccggtgtcggacgcgaagtacagccgcatcccgcgcgtcagaccggacgcgggctcacccgcctctatcaccccggtcggctggaccccgcacccgacgagcgcggtccccagtaccgtgaggacgacttcccgcacccgcctcgtccgtccacctccccgcacgcgcctcacccctcctcctccgggtgccgcagaggcagccgcagcgtgaacaacgcgccgccctccgggcgttgggccacctcgatggtgccgccgtgcagccgcgcgttctccagcgcgatggccatgccgaggccgctgccctgcccgaagcttccgtcctccccgacgcctccgccctgcccgaggccgccgccaccccggtctccaccc

SEQ ID NO: 4415 - DNA, 705 bp, Unknown
  Kingdom: Bacteria, Phylum: Actinobacteria, Class: Actinobacteria, Order: Streptomycetales, Family: Streptomycetaceae, Genus: Streptomyces
gagcgcccacatgcgccgccgccaccgcgtcgtccagcgcgtccccgatgaccaccgaatgctccggcgcgatgccgtccaacccggccagcgcctcgaagtgccgctccatgtggagcgccttgctcccgccggacggccccgtgcgcccctcgacgcggacgaaccgaggctcgatcccgtacccccgcaccaccggcaccagctgctcgtgcccgtacatgctcagcagcgactgactgcggccggcccgctgccactgatgcagcagctcctccaccccggcggtgagcccacagcccgcccgctgctccgcgtagtaccggtggaagatgccgtccatccgttcccactcggcctcggtgggcagccggcccaggaaccgctcgtagaaccggggtatggggatggtgtacatctcccggtactgctccagcgtgatcggcgccagctcgacctccgcgaacgcggcgttcgtcgcctggatgacggcatgggtgtcgtcgagcagtgtgccgttccagtcccagaccagatgtgtgcgtgtcgtcccggaagtcatacgcgaaaaaatacccgtcgggtccgacaacaccatccctcagccgatgagctgcggaatctcctggacgccgaaccacagcagctcgtgatcctcggccccgtccacggtgaactgcgcgtcgtcgtcaccgaggtccgccg

SEQ ID NO: 4416 - DNA, 811 bp, Unknown
  Kingdom: Bacteria, Phylum: Actinobacteria, Class: Actinobacteria, Order: Streptomycetales, Family: Streptomycetaceae, Genus: Streptomyces
ctacctcggcctctggaacgccctgcgctccggtgaatccgtcgtcgtgcacgactgcggcacccagacctgggtccgccgctggctcgcccggcacgccgtgagccggggccgcacgctccacctgatcctgctcgacgtgacgcccgaggtggcgcggcaggggcagcgcgagcgtgggcgcggggtctccggctatgccttcgcccgccaccggcacgcggtcgcccggctgctccgcgacaccgaacaggggctgctgcccgccggctgcacctccgcggtgctgctggaccgcgaggccgcgggagcgctcggccgaatctccttcacggccgccgaggcttccaccgccggctgacggttaaggtgctggccggagcagagggccgccgaggcgcggccgaggcggtggagagagggcacagaggcagtggacattccggcacccgcaccggcgcacccccagcaggggtggcccgccaacgaactcgaagaggtgctgacggcctcgctcggcgtccccgacgcgggcggccgcctcgtcgaggtgctcggccgcagctccgtctgggtgccgctgccgaacggcggcacccccgcgagcgcggacctcgacctgccgatgatggagatcgacggcgcggccttcgtccccgtcttcagctccgaggcccagttcctcagctgcgtcggcagccacatgtccttcaccgtcgcaccggcccgcgacttcgcccggggcctgcccccgcaggtcggcatcgccgtgaacccgggcgaagtcgcgggccggtgcgacggtgaagga

SEQ ID NO: 4417 - DNA, 1074 bp, Unknown
  Kingdom: Bacteria, Phylum: Actinobacteria, Class: Actinobacteria, Order: Streptomycetales, Family: Streptomycetaceae, Genus: Streptomyces
ggcggtcactggggctcctcgggcgcggcaggggcagcgggcggggtggcagtggcgggccgggcattggactcccagagcgggcagccgatgaccgggaacgtgcagtcctcgggcccgtcagggtgggtgcacgcttcgtcccagtcgttgcacccgcagtacatccccgggtggcagtagtggcccggatcggtggactgctcctggtggtggacgcaggtcgtgcaggtgcgggcggtcggctcctcgggcgcactcggggcaacgatcacgcccggcgtgacgctgtgggcaccacggtgtccgacgggcttgatgcagccggagccatcgcccgggccggtgccgtatgggcagtcggcgtcgaccagctgcacgtcggcgaaggtcagcacgatctcgccctcggtggtctgctgcaccccggcggcagccccgtcggccagcacggcccggagctcccgcgcacggtcggtgatgctggagtcgccgtactcgccacgcttctcccactcggcggccagagcctcgaacgcggcccggtcgacaggcgcgggctcggtgtcgggctcccacggcagctcctgcccgtaagcgtgcgccccgttccacccctggcagtcgtggcagccatacggcagctgcatgaccgtggtggtgaagtgccgggcctcggggtggccgcaccagcacccggcctgcgtggtggtgccgaggagctgccgggccaccgccagggcagcagccgtctcgcagggccactcggctgcctggccgtcagcgtcggcacaggtgccgcacgctccgtcgtagctctggtgcagatcagcgacgctattcagggcggcaggcagcgttgtggcggggtcgggctcggccgccgggtgctgcgtgtgctcgctggtgatgtggtcggcgaggatctgcgcccggctggccgtgtacttgtccggcaccccgtggcacgcccagtggcagcccggctcggtgcagcggatcggggtgatcgggccgaggatgctctcggcgggggtggggtcgggcatcaggggctccaggtgagtgcaggta

SEQ ID NO: 4418 - DNA, 689 bp, Unknown
  Kingdom: Bacteria, Phylum: Actinobacteria, Class: Actinobacteria, Order: Streptomycetales, Family: Streptomycetaceae, Genus: Streptomyces
ctccagcgtggcgtccaggtcaccggcggcacgcggggcccggttgtgcggcagcttggagaggaccgcggccatcccgcaggtgttgctgagcgccgagtacaccaggcccgagccgacgcccgccgacagccagcgcgccgccgggtagcggatgcccgccaccagccccgccaccaccagcgagcccgccgcgagccgtacctgacgctccatgggccaggtggtgcgcgcgccctcgggacggtccaggccacggccgtcgccctcccaggccgacgttccgccggtcagcgtcacggcctcgatgtccgctcccgcgaggatctcgcaggcacgcgtggaccggaccccggaagcgcacaccaccagcagcgaaccgcgcgcggaggcggacttgagcgcgggcagcgcgtccggaagcttgtcgagcgggatgttcagggcgcccggaacgtgtccggcggcgtactcgcccggagcccgcacgtcgatgacggtgaactcctccagacgggctgcggcctgggcgggggagagggatgcggggctgggcacgagcgggttcctttcgttcgccggagcggaggctgaggggcgcccccacccggcccggaagaccgggccggccgtgttcgcggtgaccgtcaccggactccagcctcgcacgcccggcgtcggagccgggc

SEQ ID NO: 4419 - DNA, 822 bp, Unknown
  Kingdom: Bacteria, Phylum: Actinobacteria, Class: Actinobacteria, Order: Streptomycetales, Family: Streptomycetaceae, Genus: Streptomyces
catcagccgggtcatctcgcgcttctcctcgggcagcaccagtgtgacgacgctgccggactccccggcgcgcgccgtgcgcccgccgcggtggaggtagtccttgtggtcggtcggcgggtccacgttgacgaccaggtcgaggtcgtcgacgtggatgccgcgggccgcgacgttcgtcgcgacgagcgcggtgacctgcccgttcttgaactggtcgagcgtccggttgcgctgcggctgcgagcgcccgccgtgcagggcggcagcccgtacaccgctggcgagcagccgcttggcgaaacggtcggcggcgcgcttggtgtcgacgaacatgatcacccggccctcgcgggcggcgatcttcgtggcgacggccttcttgtcggtctcgtccagtacgtggaggacgtggtgctccatcgtggtgaccgcaccggcggacgggtcgacggagtgcacgaccgggtcggtgaggaacatcttcacgagccggtcgatgttcttgtcgagggtcgcggagaacagcatccgctggccgtccgcctcgacctgcttgagcagggcgacgacctgcggcatgaagcccatgtcggccatctggtcggcctcgtcgaggacagtgatggacacctcgtccaggcggcagtcgccgcgctcgatgaggtccttgagccggccgggggtggcgacgagcacctcggcgccgcgccgcagggtggcggactgcttggtgatcgacatgccgccgacgacggtggccatccgcaggttcacggcggtcgcgtacggggtcagcgcgtcggtgacctgctgggccag

SEQ ID NO: 4420 - DNA, 1194 bp, Unknown
  Kingdom: Bacteria, Phylum: Actinobacteria, Class: Actinobacteria, Order: Streptomycetales, Family: Streptomycetaceae, Genus: Streptomyces
ctccaggaaggagttgttctgcgagccgccgacgtacgggcgcgaggaagccggcatcagctcaacgatcgcgacccaccagccgccggcgacgaccgtcgtgagcgcggccagggcgagttggccgagccgcttcgccacgggaacgggggcgcacaccgcgtacagcacggccagcggcggcaggatcaggaacgcctggagggtcttcgtcaggaacgcgaacccgaccgccgcacccgcccacagcagccacgtcgtccgcccccgctccagtgctcgcagcacgcaccagacagtgaccgtcatcagcagggccagcagcgcgtccgggttgttgaagcggaacatcagcgccgcgacgggcgtcagcgcgaacacgcccaccgcgatcagcccggcgacaggcccgaaacgacggcgtacggcggtgttcagcacggccgccgtggcgagcgccatcaggacctggggggtcaggatcgcccaggagttcagcccgaacagccgcaccgacacggccatcggccagagcgcggcgggcggcttgtcgacggtgatggcgcctccggagtccagcgagccgaagaagagggccttccagctctggctgcccgcctggacggcagcggagtagaaggagttggcgtatccggaggcgctgaggttccagaggtacgcgagcccgaccgccagcagcagcccgtacagcgcgggtcgcgcccagcgggggccgggatcgggttccgacggccgggacggcggtgccggaaccgggatcgaggggacggcggcggtcgtggtcatcggacatcctcggattcgtcgccgaccgggagggcggctgctgccgcgggcaacagcggctccacgtggtcccgttcggcggtgcggcgctccgggaagacccaggagcgcaggagcaggaagcgcagcacggtggccgcgaggttggcggtgatcagtacggccagctccgtgccgtgcgagggcgcaccggaagccgcccccagcgcggcgagcgagccgctggtcagcgcgaggccgatggcgaggaccacgagtccctgcgcctggtggcggacggccccgtcccggccgcgcacaccgaaggtgagacggcggttggcggccgtgttggcgacggcggagacgagcagcgcgccgccgttggcggtctgcgggccgacgccg

SEQ ID NO: 4421 - DNA, 1304 bp, Unknown
  Kingdom: Bacteria, Phylum: Actinobacteria, Class: Actinobacteria, Order: Streptomycetales, Family: Streptomycetaceae, Genus: Streptomyces
cccccgtccccgtagccgcactgctccccactcccgcagcatcgacgtcacctctccgcttcggctcggcccgcacggccccggcacggccccgcacggcccggcacaccggacacgcacacgacgtacgggtccgcgcaccgcgtacgggtcccgcacggcgcacggcaccccgcacacgacgtacgggtcccgcgcaccgcgttcggggttcgtgtccgccagtcacggccccgcgcacgacgccgtacgggcatggcgcgcacggtaggggcaaacctcacaactctccagacttcccccccttctcctccccttcccatcccctcttctcatccccgccctctcctccacgccgcgaccgtccggcagtaccgtgtggtccatgcgccccgacacgcctgccgaccacaccaccgaagccgagcgtctgctccgcaccgcggcgcagtaccccgaggaccacgaaccgctgatcctccaggccgcggcccatctggaactcgcgggcgaccgcgcccgcgcgagcacgctctacgacgacctgctcgggggccccgaggccaccgtcgacaacccgcatctgatcaagtccctgaaggcggccaacctctgggagtacggccacgaggccgaggcccgggcgatcatcgacggcatccgtgccgcgggcccgctggacgcggcgccgtggcaggtggccgcagagaccctggaggcgcacgacgagctggagtcggcgcacgacttcttctcgaccgcgctgaccctgctgctggcccccggcgaggaggtcccgtacgccgtccagtccctgctgaccggccgccaccgggtgcgcaggctgatgggcctggaccacgacgcctgggacgagctggccggcgcgctgcacacggccccggtccccctggacgaactccacgaccccaagcgcctgtggtcgctgggctcctcggacccggtcgagctgaaggccgagatcacccgcctccgcgcggagctgggcacctaccgcacggccctctcccgcccgttcccggtcgccgtcctgcactggcccgagcacgagctgcgcgaactgctcaccgcgtacccggcgttgaccgaggagtacgtggaccgcgccacacacctggaccgcctggaggccgcgctccgggacctccacgcgacgggaaccccgaatctgggcatcgtgacgggcacggtcccctcgtacgaggcgttcgccgcctccgaggccgcgtccccggccgacccgggcctcctcccccagtacgccaccaccctcgccgcccggg

SEQ ID NO: 4422 - DNA, 3175 bp, Unknown
  Kingdom: Bacteria, Phylum: Actinobacteria, Class: Actinobacteria, Order: Streptomycetales, Family: Streptomycetaceae, Genus: Streptomyces
actggatctcggcgggcccgggccgcgagatccagcgcgaccagcccggacgcctcctccgcggacaccgtgaacccgggcccgccgagatccagttgcgtactgatgcggttcgccgcgaggttcggcatgctgcccaccacgccctccgccgtcatgggcggagtgaaggcgtccggggcgagatccgccgacggaccggtgagggcctttcccgcctgctccatccagtacggaacccgccagcgggcacccgcgcgcgccacctccgggtccacccccgtaccgatgaccaccatggtccgctcgcgcggcaggctcaccgtccgtacggcctcccgggcggcctccaggaccaggagctgatggcgcacggtccgctccaggcccagcggcgggaagcacagctccgtcagctccacggggatctccactacggggccgcgccgttcaccgcccagcaccgcccgccggaagtcctcggtggacgtcccctcgccgacccgggcaccgacggcgacgatggctaccgctgtacgggagctccgcgcgccgggtgccggatccgaggacggaacaccggcggccggcgcggcacgccggacaccggatgccaagccccgcgccggaccggatgcgggggacgggggcgcgtcctgcggatggtcgacgatcacgtgggcgttggtcccgccgaacccgaaggcgctcaccgcggccctgcgcggacccacccactcctccggtgcggacagcacccgcaacggcgtgcccgccagcgcgtccagcggccggccgacgccgagcgtcgccggacggacccccgcacgcatcgctccgagcaccttcagcagccccgtcacgcctgccgacgccagcaggtggccgacgttcgacttggccgaaccgatgggcaggtcgtcggcgtccccgaagacccgggccatgccgcgcgcctccaccgcgtcacccaccggcgtccccgtcgcatggcactccacgagcgacaccgactcgggagcgacgcccgccctgtcgtatgccaggcgcatggcccgcacctggccctcctccgacgggctgatcagccccgagccacgcccgtcgttggacagccccacaccgcggatcacaccgagcaccggcaggccggcggcgcgtgccccggagagccgcatcagggcgacgaacccggccccctcgccgtgcaccagcccgtccgcgtcccggtggaaggggcggctgcgccccgtgcggctcgtcgccgacagaccgcagaaccccacgtgcaggtagaggggatcggggcggctgaccgcaccggccaccatcaggtcggcggtgccgtcgtgcagccggtcgcacgccagcttgatcgcgtacagggaggacgcgcaggcggcgtcgagggaccacgctcccgccccgagtcccagcgcgcgggccgcgagcagagcgggcagcccggacgagaagcggttacgggcgtcggggcgtgcacgacgctcacccgtcagcaaggcgtcgcgcagccgcggccgctgggcggacagccagacgtgttcggcgaaggccgccccggcgggcgtcgggtaggacaggttccccagcaccagcccgccgcgcggaaccgggcccgtgcggcccgcctcggcgagcgcctgccgtaccccgtacaggacccagtggaagagcgggtccagtgacgcgattcgctcgggggcgatccggaagccgcccgggtcgaagacggactcgaacccctggacgtagccgccgacatcggtccaggtgcggtcgaggtggttgtccaccgtgcccatggcccagcggtgcggcaaccgccaccggccggccggggcggccgacaggctcacccggcccgcggcgatgttctcccagaacgtgtccgggtcgagcgcgccgggcagtacacagccccgtccgacgacggcgatcggttcgacaggcatacggatctcgcttcgcggcagggcggaggccggggacggggtcaggaggggcggcggacgagttcgacgccgatcagctccagccggacggaaccgtcggcgtcgatcagtgccgcgtcgcagcgcgcccccgcgtcgtgcgccttccgtccccggacgacacatcgcacggtgccgtccaccggaccgtgccgatgcaccttgcattcggccacggacatcggcagcgtcgccgcaccgagcaccttctcgccccagagcagggcgagttggagagcaccgtccacggcggccgcgtcgaggggccagtgctcgcccgaccagtccagggcgcgcagccccgcgacggtcgcctcggctccgtgctccgagacaccgcgcaccgtgcgcagggcctggaaccgggggccgtggaagaggacctccccgtcgtaccaggcggtccggtccagcggcttcaggccgtccggggtgtcccacgcgcccgcgtccccgtccccgtccccgtcgccgggaccgaggacggcccggaagtacgccgggccgtcctcgcccagcagttccgcctccaggccggagggataccccggtgcaccccggctgccgagcagggtgagccggtggcccgtgccggacagctccggcagggggtacttcctgtacacccgcagatcacgcaggacgaggcgtcctgcggtcggcagccacgcggcggccgcacccgcgaaccagttcagcaccagggccacgggcagtaccggcacgtcggcgggcgcgtggtcggccagctgcggcagggagtccgagcggacgagcaactgtgcgcgacggggatcaacggccggcgacagggcggccgggccgtccccggccgtcaggatgacacgggcctcaccggcggagccgtccagctcggcggtgaaggccgcagcgccctgggccagcgggatgagcgggacccccgaccggccgaaacgcgcggccagggctggggtgaccatgccgccctgccagggaccccaggccacgcaccgcaccagacagccggggcggcgggcctgttcggccgacgcgacgtgctggaggatctcgttggccatggcgtagtcgctctgccccggattgccgaacacggcggcgacggcggacgatcccctggacaccatctgcctgttctcctcggtcgccgccgtgttcggcaa

SEQ ID NO: 4423 - DNA, 755 bp, Unknown
  Kingdom: Bacteria, Phylum: Actinobacteria, Class: Actinobacteria, Order: Streptomycetales, Family: Streptomycetaceae, Genus: Streptomyces
ggcctgtacgcccacgagcgcgaaggcgtgtgacgggagccggttccgcgcggaaggaccccggggctgccacagccccggggtccttccgcgcgcggtcgctcagcccagggtgagcagctccagcaggccggtctccccggacccgtcgaccccgtcggtcccgtccgccgcggtggtgcggtcgggaccggtcgtgccgccggagaggaagtgcagggacatcagcaggcccgccgctccggtggccaggtcggcggagcagcgcatcagccccgcgcccgggacgagcagccggtcctcgtcggcgaccaggtgccaggacaggttgcgtacggaggccaggaccccgggggccgtacggccgtccggcgacagggcgcccgccacggccatgagccccgcgcggccggtgaacaggcccggctcgcggacgaattcgaaggcgcatcccctggccaccccgggcagcagggcggcgagcgccgggaagtcgcgacgggccagataggcccgggccaccagggcgaaaccgccgctcccccggtccaggtagagcaggtgccgtcggccgtccttcacctggacggtgccgtccggcatggtcacacagtgggccgcctccgcctccagggcccggccggcggccgccaggaactgctcgtcgccggtcagggagtgcagttcgaggtggagcagggccgcaccgctcagcccgcgcagcagacccgccgacgcgggctgagcggtgcggc

SEQ ID NO: 4424 - DNA, 518 bp, Unknown
  Kingdom: Bacteria, Phylum: Actinobacteria, Class: Actinobacteria, Order: Streptomycetales, Family: Streptomycetaceae, Genus: Streptomyces
cggccagctcatcggcccggtcgccgcgggcgcgctcatctccggacagggcggaaccctggggcggacgagcgcgctggccctcctcgtatcggccgcggtcgccgccgtcgccctcacctcgctctggcgcatcgagcgccgccgggcgaaaggcgccggcgccaagcccggccacaaggtcccggtccgcgcgatcctgggcgcgcgcggcgtccccgcgggcatcttcatcagcatggcggtgctgtccgccaccgacatcctcaccgcctacctgccggtcgtcggcgaacaccgctccatcgcgccggccaccgtcggactgctgctgagcctgcgcgccgccgccacgatcgcctgccggctggtcatgtcggcgctgctgcggctgctcggccgcagggtcctgctgaccaccagctgcctgctcgccgggctcctctgcgcgggcgccgccctccccgtgtccgtcccggtcctcgccgtcatgctcgccgtgctcggcttctgcctcg

SEQ ID NO: 4425 - DNA, 514 bp, Unknown
  Kingdom: Bacteria, Phylum: Actinobacteria, Class: Actinobacteria, Order: Streptomycetales, Family: Streptomycetaceae, Genus: Streptomyces
gaggtcgtcggggtggacccggtcttcgtgatgctgccggagaaccaccccctggccggtgaggcggagctggacctggccgcgctcgcggacgagtgctgggcggacgtgcccggcgacggctgcttcgccgactgcttcaccgcggcctgcgcgcggtcgggcttcaccccggtgtcggtgtacgagacggacacctcctccgtcgtccatctggtgcaggtggggcgggcgatagggctgtgccgggcgacgttcccgccggcgcccggcctggtgaccagaccgctggcaggcgcgccgctcagctggcgtcatctggtgggctggcacccgcactcccccgccgcggacgccgcggcggggacggtggccggagcgacccgagcggcctacgcggaggcggtgtcgcgcagcccgagctacgcgcggtggctcggcgcgcacccgaggttcggcacggtggcctgagcccgggacgggtccggggttcggcacggtggcctgagcccgg

SEQ ID NO: 4426 - DNA, 1837 bp, Unknown
  Kingdom: Bacteria, Phylum: Actinobacteria, Class: Actinobacteria, Order: Streptomycetales, Family: Streptomycetaceae, Genus: Streptomyces
ccccaccaccggcccgttcgcccccgcgcggccctccctcgggccgctcccgctgccggtgccgccgctgcccgggttcctggacggcgaggaggggaagggcacgggcgaggcgagcgaggtgctgacgcggctcaccgtctccgtcgagaacaccggggtcgccggcgccgacggcaccttcgagctggagtgcgggcccaccggggggagccacccgcaggggcaggccgcctgtgaccggctggcggaggccggcgccacccgggccgggcggcaggagctgttccggccaacccctgagggcacgatgtgcacgatgatccacggcggcgacgccaccgcgcgcatcgtgggcacctgggagggccgggccgtggacaccaccgcgagccgccgcgacggatgcgagatcgcgcgctggaacagcctcgtgccggtgcttccggatgtccgatagtccgtcggtgatggcgtaaaagcgttcgccctcccgtacctgtcgcagccgactcctgggcccggcgtgccctgagcggcggggccacgccgcgcgtccgcgcacgtcacagggtgcgcggacgctcacgtcataggcccgtggcgtaggcaccgcacacagaaccttggtgagagctccccctcatccgccgcccccggagcctcccctgcccttagactcctccagtgacagtctgcggcccgaggggcaagatggggcccgctgtcggcaaggtgcggtaatcagggaggaagcgtcgtcgtgagcagcaggccatcccgaggcactgctcgcctcgcagccatactcgatgcccttcctgacgggcttctgctcgtcaattgcaacggcacggtcgtcaacgccaacgccatcgccctcgaaatgttcgagaccccaggcaccgcgctcgtcggtcgcggactgctcgatctgctgccggagttcgactccaagctgatcccgggttcgatgcgccggcccgaggctgcggacgagcagggcaggaccaagccgacgcggatgaccgcgcggcgcaccgacggcaacgagtaccccgtcgaggtcaccagcgcgagcctcgacagcgggcaggccgcgtacaacgacatccactccagctacaccggtgacgagctgctcatgctcgtcgtgcgggacctctccggcacggtcgacaccgaggcggagctggcccgttcgcagcggcagaccgagatgatcctgcgggccgcctccgagggcgtcgtcggcacggacaccgacgggcgcgtcgtcctcgtcaaccccgccgccgcgcagatcctcggcttccgggccagcgacctcggcggccaggagctgcatccgctgatcctgcactcacgggcggagggtgagccgttcccgtacgaggactccccgctcgccgacaccctcaagtccgggcgcaagcaccgggtgcgcgggcaggtgctgtggtccaagagcggcgcgcaggtgccggtggacctgacgaccgctccggtacgggacggggaccagctcgtcggcgcggtgatgacgttcaccgatcgccggccgtacgaggagttgtcggcgcagcacacgagcgtcgtcgccgagctgaccacgagccactccgccgaggtcaccgcgctcaaggaggcgcacgccgccgaactggaggcgctgaacgaggcgcacgcggccgagctcgccgaccggaccgagcggtacgcctccgagatcgagggacaggccgagctgctcgcctccctgggcgcccagcactcccagctcaccgccgtcctcggcggttcgctgcgcgggcccctggaggaactgcgcggcgag

SEQ ID NO: 4427 - DNA, 740 bp, Unknown
  Kingdom: Bacteria, Phylum: Actinobacteria, Class: Actinobacteria, Order: Streptomycetales, Family: Streptomycetaceae, Genus: Streptomyces
gtgcggaggcacccttggcgtaactgatgccgtcgaagttgaggagggcggacgcggtgtcggggacggcgtcggggtccggggcgacggggtgggtggaggggcgctggtcggcgtcgtagccccagcccttccgggcgacaccgaagtcgacccaggtgtcggtgaagccggtggcctcggtgagggtctgatagcccatgtactcggcgaaggactcgttgagccagatgtcgtcccaccaggtcagggtgacgaggtcgccgaaccacatgtgggccatctcgtgggcgatgaccatggcgcgggtctggcgctcggtgtcggtgacggcggagcggtagacgaactcgtcgcggaaggtgacgagtccggggttctccatggcgcccgcgttgaactcggggacgaaggcctggtcgtaggagtcgaacgggtaggactcgtcgaacttctcgtggtagcggtcgtagcaggcgcgggtgatgtcgaggatctcgtcggcgtcggcgtccaggtacggggcgagggagcggcggcagtggatgccgaagggcagtccggcgtgctcggtggtgaccgagtgccagggtcctgcggcgaccgcgacgaggtaggtggagacgaggggcgtggcggcgatggtccagcggccctcccccgtgtgttcggcgacgccgttgccgaggacggtccagccttcgggggcggtgacgtcgatggagaagacggacttgagg

SEQ ID NO: 4428 - DNA, 1060 bp, Unknown
  Kingdom: Bacteria, Phylum: Actinobacteria, Class: Actinobacteria, Order: Streptomycetales, Family: Streptomycetaceae, Genus: Streptomyces
gccaggcggcgtgcagggtgcgggcctcgaccagctccttgcggccggcggcggcgctcttctcggcggcggtcagggccagcgaggcgtgccggtaggcgagttcggcggcgatcagggaacggctgtcgcgggtggactcggcctcggtgacggtgtgggcggcggcggtgacccgtccggccagctcggcggtgcggccgcgctcctcggcggcgcgggcggtcagacggcgggccagggtgcgggtgcggcgttcggcgccggcatggatgtcgcgggtgcgggcccgggtgtcggtggcctcgacaatccggttgaggaggtccacggagcccgcggtgaagtcgcgttcggcggtcagctcggcgcggcggcccagcttgttgccgaagccgctgacgaggtcggcgagtccgtcggtgtcgcgggtgtcggtgacggcgcggagcaggaggtcggtgaagtcggagtccttcttcaccgcgaagagcccggcggcctcgccctcgtcggcgttcatctcgcgctggtagcggaagagttcggggtcgaggccgaggtcgccgaggtgttcgttccagcggtcgtggatctcttcccagtgcacgtcgaggtgcgcgtagaacttgccggcgtccatcagcgcgtcgcggaagcccttcatggtgcgccgcctgccgcgtgcgccggagacgccttcggcgggtcggcccacggcggaggactcggcgacgggcaggctgtccaggctgagcccgggtccgggccggaacgaataccaggcctcggcgaacttgcgggggtcgttggagacctgacggccgcgccactcgctgaccttgccgacgacgacgcattcaccggtgagggtgtgctgccactccagggcgacgtgcccgcagtcgtcggcgaggaggaacttgcgcagcacgccggagctggcgccgccgagggtgttgcggtggccggggagcatcaccgagaagatcagcttgagcaggacggacttgccgccgccgttctccaggaagaggacgcccgcgggggcggcaagtcc

SEQ ID NO: 4429 - DNA, 1028 bp, Unknown
  Kingdom: Bacteria, Phylum: Actinobacteria, Class: Actinobacteria, Order: Streptomycetales, Family: Streptomycetaceae, Genus: Streptomyces
ggcccaagacctccagccagagcgtccagtgcgggtcccggtgcccggcgggcaggtagaggtcgatgtacgcctccagccgctcgcgagccgtccccggccgggcgagcagcgcgccgcgctcggcgccgaggcgccgctcgctccactccagggtctggaggagcagttcgtccttggtgcggaagtagtagaggaggtgcccgctgctcatccccacctcccgtcccagcccggccatggtcagcccgtcgagcccgcgctcggcgatggtggccatggcggcggcgaggacgtcctcgcggggcggggctgcgtggtgggtgcggcggggggcggaggtcatgggaccggactttcggaagcggttcgggttcaggttcgggttcagatcttcggctgctgctgggtgatgcagtggatgcctccaccgccggcgaagatcgtacgggcgtcgacgagggtcaccgtacggtccgggaacaggccccggaagatcgcggcggcctcctcgtcgcgcgggtcgtcgaaggcgcagaggatcacggcgtcgttgcagaggtagtggttgatgtaggagtagtcgacccacgcgccgtcctcgtcgcggagcacggtcggcgcgggcacctcgacgacctccagaaggcggcccctggcgtcggtggcggcccgcaggatcgccaggttctcccgggtgacctcgtggtcggggtgggccggatccggctggacgtgggcgacgacggtgcccgggcgggcgaaggccgcgacgatgtcgacatggccgagcgtgccgtacgtcccgtagtcgccggtcagcccccggggcagccagatggccttctcggtgccgaggcgggcgtgcacctccgcctcgacccgctcccgggtccagccggggttgcgctcctcgccgagctggacggtctcggtgagcaggacggtgccttcgccgtccacgtggatcgcgccgccctcgttgacgagcggggagctgtggacggggacgccggtcagctcggcga

SEQ ID NO: 4430 - DNA, 1319 bp, Unknown
  Kingdom: Bacteria, Phylum: Actinobacteria, Class: Actinobacteria, Order: Streptomycetales, Family: Streptomycetaceae, Genus: Streptomyces
cgaggtcggccgtaccaccgtgccgtgcggctggcggcgcggtggtacgggcgacctcgtagcggctccccttgcgccggaccccgcgcggccggaacaccgcgggtacggggacgacgcctggcgaacatgtcccatgtgtgatttccccctccccgcctgccgcgaaacagcgccttgcgggatgctgtggataacgttcgttcacatccccggcccttcaggcgcgggagaccaggtggaggcagtgatgggtgtgaccggtccgatccgtgtggtggtggccaagccgggactcgacggccacgaccgcggggccaaagtcatcgcgcgggcgttgcgcgacgccggtatggaggtgatctacacggggctccaccagacgcccgagcagatcgtcgacacggcgatccaggaggacgccgacgccatcggcctctcgatcctctccggggcgcacaacacgctgttcgccaaggtgatcgagctgctgaaggaccgggaggcggaggacatcaaggtgttcggcggcgggatcatcccggaggacgacatcgcaccgttgaagaagctgggcgtcgcggagctcttcacgccgggggcgacgacgaccgagatcgtcacctgggtcaacgccaacgtccgccaggccgcccaggcctgaacgccgcacccgggagcgggcccgctgcgtacgggcccgcgcgggcggcggaggtgccgtcgccggcccgggccgcggacctcgccctccccccgcccatgccttcgctcccgtcgcggcggcgggagatcagctccgcagggagctccgcagatctgcttcgcctccatcgcggcgtcaggacatcagctccgcttccatcgcggcgcgcagccgcagggtggagaccaggcgctggaaggcctccgaccagtagccgcccgcccccggcgaagccccctcctgctcgtcctgcgccgctgtcaggacctccagccggtcggcctcggccggatccagacagcgttccgcgaggcccatcactccgctgaagctccacggataactcccgccgtcccgcgcgatgtcgagagcgtcgaccaccgcacgtccgagcggcccggcccaggggaccgtgcacaccccgagcagctggaacgcctccgagaggccgtgcgcggcgatgaactcggccacccaggaagcgcgttcggcttggtccaggatcgcgaggagcttcgagcgctcggcgatcgaggccgtcccggggccgctcgccgggggtgccgaagggcgcccgagcagggcccgggcccactgcggattccgctgccgc

SEQ ID NO: 4431 - DNA, 765 bp, Unknown
  Kingdom: Bacteria, Phylum: Actinobacteria, Class: Actinobacteria, Order: Streptomycetales, Family: Streptomycetaceae, Genus: Streptomyces
cgcgacaccgggggagaggaggccttcgggccccggcccgggggtcgggagcagcggcggggcggccgccacggccgccgggcgcgccccggtctccgtccccgtaccggtgtcgctcatgcggcgctcacccggtccgggccggtcagcgcccaccaggcggccagccccagcacgaccccgctcagcaccgtggtgggcccgccgatgtccgcgtacaggaagttgacgctctgccaggtcatcagggccaccgccgccagcccgcagtccagggccgcgtgtccgcgcgagcgggccaggcacagtctgcggatcgcgccggccaggatcgcggcccaactgccgaggagcgcggtcagaccgacgaggccctgctcgctgaggacgaggagatacatgttgtgcggggagaggagcgcctgacggcggaactcctggcccgccccggcggtgtcgctgccggaggagagcccgatggaggcgtgtccgtcgcggtggccggggaagcccttgaggccgaccccggtggccggccgctcccgccacatcgtgcccgccgcgctccacatcgcgtagcggtcgctgaccgaccggtccggggtgctggtcacccgggtgacgctggcggcccggtccgcgatcatctcggagccgatgccgaacccgccgaccagcacgactccggcagcgcccagtacggccagcgacgtcagcgcctgccgccgcccggtcagcgccaggacgacgaggaccgcggcggcc

SEQ ID NO: 4432 - DNA, 697 bp, Unknown
  Kingdom: Bacteria, Phylum: Actinobacteria, Class: Actinobacteria, Order: Streptomycetales, Family: Streptomycetaceae, Genus: Streptomyces
  misc_feature (374)..(445): n is a, c, g, or t
tcgcggacgagcgggtcggtctcgccgcgtgcgtcggcgccacctggatcggcggcggcgtgaccggcacggtcgaactgctggacaggagcctccggcccggtggtctgatgctgatcggcgagccgtactggcgcaaggaagtgccggaccgggaaaccgcccagggctgtcacgccggcgacgaggacgacttcctcgtgctgccggagctgatcgagcggttcggcgacatcgggtacgacgtcgtggagatggtgctggccgaccaggacagctgggaccggtaccgggccgcgcagtggctcaacctccgccgctggctcgccgcgcaccccgatgacgagctggccgccgaggtgcggagcgaactnnnnnnnnnnnnnnnnnnnnnnnnnnnnnnnnnnnnnnnnnnnnnnnnnnnnnnnnnnnnnnnnnnnnnnnngatggcccgctgacggcctgaggcccgctgaagaaccgatcggcgcggggtccggccagcacatgctgcccggaccccgcgcacgtacccgcggcggttcagcgcgtcgcggggacgagcgcccgccgctccgcacgcgccacccgggtcccgtacagggtgatcgagacgaccccgaggaccgcgagcaggcccagggccaccgtcgccgtccagcccccggcgtggaaggcgaccgcgccgagcgtgccg

SEQ ID NO: 4433 - DNA, 1067 bp, Unknown
  Kingdom: Bacteria, Phylum: Actinobacteria, Class: Actinobacteria, Order: Streptomycetales, Family: Streptomycetaceae, Genus: Streptomyces
gggccaggccggtcaggtcgagcaccgagccgcccgcgttctgtgccgcgtccccgggcgaccgccccagcccgcgcgcgatgacgccccggggaccgcgcccccggacgacggcggccgcctcctcgtgggtacgggggcggaaccggacggcggtcgtcggggcggtgcggccccagccggtcaaggacaccgtgtcgacggacatgagggtgaccgtatcgtccgggaaatccccttcgcggcattggtgaattcgctcaccggaacgggtgatggagtgagtgtcagcaaagcgtggcggggttccgccggacgtgtccgggagagtccggggcgggccgtcaatgttccgggcccaggagggtacgggtgacgtcatggactggctgaagaagctcccggtgatcgggcccctggtcgcccggctgatggagacgcacgcatggcgttcctacgagcggctggaccgggtccactgggccaggctcgcggcggcgatcaccttcatcagcttcctggccctcttcccgctgatcgcggtcggcgcggccgtcgccgccgccctgctgagcgacgagcaactggacaccatcaaggacaagctcgccgaccaggtgcccggcatctccgatcagctgggcatcgacggactggtcgccaacgcgggcacggtcggcctggtggcgggtgccctgctgctgttcacgggtgtcggctgggtcgggtcgatgcgggagtgcctgcgcgcggtctgggaactggacgacgtccagaaggccaatcccgtcgtcgccaaggtgaaggacgccgtgctgctggtcggcctcggcggcgcggcgctcgccactctggcggtctccaccatcggctcgacggcggtcggctggaccgccgacctgatcggcatccccgaggacggggccggcggcatcctgctgcgggtggccgccctggcggtcgcggtcgtcgccggcttcctgctgctcctctatctgctgacgctgctgcccggggtggagccgccccggcggcggctggtggtggcggccctgctcggcgcggtc

SEQ ID NO: 4434 - DNA, 670 bp, Unknown
  Kingdom: Bacteria, Phylum: Actinobacteria, Class: Actinobacteria, Order: Streptomycetales, Family: Streptomycetaceae, Genus: Streptomyces
ccgtcaccgcgagcgtgaagtcaccgcgaccggtccgtcaccgcgaccggtccgtcaccgcgagcgtgaagtcaccgcgaccggtccgtctccgtgagcggtccgtacgcgtccgggcggcgggtggtcaggaacgggaacagctccagccagtcgcggcgggcatcgagatcgagatcggcgacgagcacggcgggctcgtcacggggggcctgggccagaacgcggccgtacgggtccacgatgaaggaactgccgtagaaggtgaggccgttctcggcgccgatgcggttcggcacgatcatgaaggtggcgttggcgatggcgttcccggtgatcaccttctgccagagcggctgggagtcgaagccggggaagcccggctcggagccgatggcggtcgggtagacgaggacgtcggccccggcgagcgagtaggcgcgcgccagctccgggaaccactggtcccagcaggtcggcaggccgaaccgggcctcgtcgaccgtgaccagcgggaaggcgtcctcgcccgccggaccggggcggaaccagtcgtcctcgtaatacccctcggtgaccgggatatgggtcttacgggtgcgctgggcgagggtgccgtcgggggcgacgaggatcgcggtgttgtagccgaggccgtcgtcctcaccgc

SEQ ID NO: 4435 - DNA, 987 bp, Unknown
  Kingdom: Bacteria, Phylum: Actinobacteria, Class: Actinobacteria, Order: Streptomycetales, Family: Streptomycetaceae, Genus: Streptomyces
gtcggccgccgacaggaacacctggacgcactgctgtccccggtggtcgagcaggaccttgcggatgcgctgcggcagcgccggatcgcggcgcgaggccgggccgaagcgggccggggcggtgcgccgccgcccggaggggtcggtgaagacgagatcggggcgcggggcccccggtgactcgggccggcccagcggtgtggtgctcaccaccggtcgtcctccctgaactcggcgtggacggagggctcggcgcggtcggcgtcggtcctggcactgccgccggtgctctgccggggcaggaccgtgtcgacgacgcccatccgcagcggggtgagccggatcagacccgcgtaccgcccggaggaggtccacagcgcgtcctcgaccggcggcgaaccgctcttgcgccaggcggcctcgacctcgccctggagggtcgccggggcgaaccggatccacagggcggcctccgggtcgcggctgaggagggctccctgttccggcgaggacagctggacgacggatccccggtccgcttcccggcccaccagctcggcgacccgcagcgaatcggtgcccagcagcccggcggccgtggtgcgggcccggtggtcggccgggtacggcggcggggccagcaccccgtagcgccacaggtggtggcgggctgcggacagcagttcgcggacccgctgctcggtccgcgagagcgcgagcgccccggcctgaccgcgttcgacggcaccccagtagggggccatggcggccatcgcggtgttgcggaggtccccggcgatggtggcgaccaggtccggtccgccctcaccgatctcccggtcgagccagcgcggtgcgcggtcgccctcgccgctctcccacgggacgtcgtcaggaccggcggggtacgcggccggggaaggcgcgccggacggaccggggtccccgccgtaccggtcgtcgtcccggccggcgtcgtgatcgccg

SEQ ID NO: 4436 - DNA, 887 bp, Unknown
  Kingdom: Bacteria, Phylum: Actinobacteria, Class: Actinobacteria, Order: Streptomycetales, Family: Streptomycetaceae, Genus: Streptomyces
gtcaggctacgggattccggtcgcgggaccccggggcgcgcggccggaatcccgtagcctgacgatcatgttcgtactcgaattgacctacacggctccggtcgaacgcgtcgacgcgctgatgcgggaacacatcgcctggctcgacgagcagtacgcggcgggcgtgttcatcgcctccggccgcaagaacccccgggacggcggagtgatcctggccgtcggggaggaccgggcggcgatcgagaggaccgcggcggccgacccgttcgccgagcacggtgtgtgcgcgtaccggatcaccgagttcatcgccaccaagacggcgcccgcactcgctccgtaccagcagccgttgccgtgacgagcggccgggaccgccctcccggctcggccccggccgatgagtttccggggcggggccggtctgcacaggtatggaaacgtacacactcaagacagccggggccgacctcgtccacgacgttcgcggacccctgccgaccgctgacggccgcccgccgttgctcatgatcgggcagcccatggacgccaccggattcgtcgcgctcgcggcacgcttccccgagcggaccgtggtgacctatgacccgcgggggctcggccgcagcatccgcaaggacggccggaccgaccacacgcccgagacccaggccgacgatgtgcacgccgtcatcgaggctctcggggccgggccggtcgagatgttcgccagcagcggcggagcggtcaccgctctcgccctcgtggcgcgccaccccggtgatgtgaccaccctcgtcgcgcacgagccgccgctcatcacgctcaccccggacggtgcggcggccgtccgggcgcgggccggggtccgggacgcgtacgag

SEQ ID NO: 4437 - DNA, 670 bp, Unknown
  Kingdom: Bacteria, Phylum: Actinobacteria, Class: Actinobacteria, Order: Streptomycetales, Family: Streptomycetaceae, Genus: Streptomyces
gtgcaccgccccgtgcaccgccttctccggcagagcaccgtcggccagcagaccggcggcggtcgcggcgaagcggtccccggctccgcaggcgtcgcccggcgcgcagtggggtgcgggcaccagcaacggagcgtctccgtgtgagagcagggccccgtccggccccaaggtcaccgcgaccgagctgacaccccagcttcggatcaacttgcgtgcgtcctcggccgcgtggtgcagttcgggccgtgcaccgtcgccgtgggcaccgccccgggccgtcacctcctcggcgcgagcggctgacgcacgggcctcggccgcggagggggtgacgagcctggtccctttcaccggcggcccgcccctggggtgggggtcccagaccacaggcaccttgcgggcggcgcgggcgagcgcgtcccgcaggacgtcggcggtgccccggccgtagtcggcgaccagaatggccgaggcggcgccgaccgccgccctcgcctcgtccgtcgccccggccgcgcgtccgtcgccgtcgtcgagcctgagtaccggcacaccctgggccagaatccgggtcttgcaggcgagttcgccggtgagggggatctcgacgatccggacgcgatcgtgcagcaggcgccgcagtgtacgggcggcctcgccgtcgccc

SEQ ID NO: 4438 - DNA, 623 bp, Unknown
  Kingdom: Bacteria, Phylum: Actinobacteria, Class: Actinobacteria, Order: Streptomycetales, Family: Streptomycetaceae, Genus: Streptomyces
ggccggcggccatcgcggcgagccgggccagccgggcggggtcgtcgccgtcggtgtgcaggtccacggggcagccgtgctcggcggcgatctccaggacggcttcggtgtagcccgtggggtcggggtcgaggtcggggcagccgccgacgacggccgcgcccatcttcaccgcgtccctcagcatcgcgagactgtccgctccggcgatgccggtgaggagccggggaaccgcgacgggcatgacgtcggcgaggccgcgcagggcgcgccgggtctgcaggacggcttcgagcggggcgaggccctggacgtcgccgacgcggacatgggtgcgcagggcggtggcaccgtggccgagctggaggagggcggcctcggtggcgcggcgctggatgtcctcggcgcggtgggaggcgggaccggggctgtcggggcccgcactgtaggcggtgagggcggtgtcgctgtgggcgtggggttcggccggggcggggagcaggagatagccgcggaggtcgatgcgggggccgcgcgcggagaggctgcccgcggtgccgacggccgaacggtcgacgtacgcctgagcggcaaccggatcgaggccgtcggcaccgcgggca

SEQ ID NO: 4439 - DNA, 566 bp, Unknown
  Kingdom: Bacteria, Phylum: Actinobacteria, Class: Actinobacteria, Order: Streptomycetales, Family: Streptomycetaceae, Genus: Streptomyces
acggacgaggggccccggcgcggggcggtcgccgtgtccgagcgccgggtggcttcgggggccggcacggctacctcccccgccacttcggcggccgcttctcggtgaaggcggcatggaactcggcgtagtcctcgccgtgcatcaggagggcctgggtgttggcgtccagctcgacggaggccgccagcggcatgtccagctcggcggtgagcagagccttggtctgcgcgagcgcgagggccgggccgtcggcgaggcggcgggccagctcggcggcgcgctcgtcggccctgccctcctcggccagttcgctgatcagcccgatccgctccgcctcgggggcgcggacggcgtccccgagcatcaggagccgggtggcgtggccgaggccgacgacccggggcagcaggtaggccgcgcccatgtcgccgcccgagaggccgacccgggtgaagaggaaggagaagcgggccgacgggtccgcgacgcggaagtccgccgccagggccagtacggccccggctccggcggcgacgccgtggacggcggcgacgacggggaag

SEQ ID NO: 4440 - DNA, 645 bp, Unknown
  Kingdom: Bacteria, Phylum: Actinobacteria, Class: Actinobacteria, Order: Streptomycetales, Family: Streptomycetaceae, Genus: Streptomyces
aggacgccgcggtacgggcgggcgtcgggcacccgcagcaggctgccgcccaggaggtgggccgcccaccaggcggcgtcctcgtcgcgggggccctcgtcggtccacagccggtccagcgcctcgatcagatcggccatccggtgcgcgagcgcggccgtgccctggcggcggccgaggagcaccatcgcctggatcaccggtccgatgcggtgccggggcacgggcaggctgcggggttcgccgacggtgcgggggtgctgcacccggtccggaccgccgctcccccggtgccagcggtgcaccagggagcgcagggccgcgtccaggtcgaggtgggctccctgcacccagtcgccgagctcctcgtgggcgaagcggtagcccgccccggcggggacgaggagtccctcggtgaggacggcggaggcccagccggtgcgccaggggaagatctcctcgaacgccgcccggtccagctcgccctggcccggacccagacagcggcgcgcggcctcgtggacctggcccgccacccgggcggcgagccggcgcacggcggtgccgcggggctgttcgtcggcgaaccccgcagcctgcccgtgccccggcaccgcatcggaccggtgatccaggcgatggtgc

SEQ ID NO: 4441 - DNA, 3020 bp, Unknown
  Kingdom: Bacteria, Phylum: Actinobacteria, Class: Actinobacteria, Order: Streptomycetales, Family: Streptomycetaceae, Genus: Streptomyces
gtgcgctacgtgccggttgcgcccgatgaggcgctgcgcccgctgctgctgcgtgggcacgaggcgctggagtcggcgcggcggggggtggagcagctcaccgaggagtaccgggcaggaggacgacggcatgacgctggacagctcgtcgaggtgatctcgggggcgagcgtgatccggcagcggctgcgtcatatggcgtacggggcccgtgaactgcggtggttctgcaaggccggccatgtggcgatgccctcggacgacaacgacgaggagtgggagcttctcgcccgtggggtgcggtacgaggccgtctacgagcgtgcgctgctggaggagccgggcatggtggacaacgttgctcggagcattcgtgcgggtgagcaggcgcgggccaccgggacgctgccggtgcggttggcgatcgcggacggcgcgatggccatctgcccgctgatgcccggcggtccgggtgattcgatgggcgagccgacggccgcggtggtgcgcggcagtagtctgctcgacgcgctgatcgcgctgttcgagagccagtgggcggcggcgtcgccgctgcacgtcacggactccggtgagctggccgacttcggcggtccgcggtccggtgcgaacgtcgccgacgacgagcggtatctgctgtccctggtggtcgccggggtcgctgacaaggcgatcgcctcgcagctcggggtcagccagcgcacggtgcagcgccggatccaggtgctgatgcagcggtccggcgccgcgacgcgaacgcagttggtgtggcatgcggcgcggcgggggtggctgtcatgacgggcgcgacgcggttcccgtactggcgcggacgccggggagcccgtcaggccgactgctgacctgacggacgtccgacgtgcgcggcagggtgccgatcagttcgtggcgaacgcgcggcgtacctcctgtgtcacctcgttgccctggttgtcccaggcccgtacgcgcagggacacatggccgtcggtgcgggacccggctgcccggacccggtagctcccgccgccctcgggcgtagtccgcgcccggctccagtgggtgccgtcgtcgtaggagacggagacctccatgcccgccaccttcgggccggtgaggccgtcctggtggcgtgcctttacctcgaatccgagggtgcgggcggccggagcgctgacgctaccgtttcggccggtggggatgtcgtagtcgagttgcagcaggggcagcagcggggtttcgcccgcgggcgggcgcggggccgtgaacgaccaactggtgcgggtggcggtcgacagcgaccattcgcgggtggtgcgttcgacagccaggtcgaggcggtaccggccgtccgcgccggtgaccgggaagtcctcccaggcggcgggcgcttcggccaggagcttgccgtcgcggtacagggcggcccgcacctcgtcggcgggggtgtcgtccaactcgccggcgtcgggcctgctgtagtggcccgcggtggcgtcggcgaactcaggtatgcgtacgaccagttcgtccttctcgcggtaggaggccagaccctcgacgttgcgggggatggcggggcgtacgacgggggcgaaccagctctcggccagccgctcgccgggccggtaggtccgcgcgggccggagcatgccggagttcaggggactgctgtcgtcccaggtcagacggtggtgcacgcggtggagccagagggtgtcaccggcgctcacgtactcggtgcgggtcagcggggtggccacgtcgcgccggtactggttgatggctgtgttcatccaggggcgccagccgaagcgctgctccgtggcatacgggacgccgcccgtgtggtggtaacgcgacacgaccgtagcggtgttggcggccgtcacccgatgcaccacccgctcgggcacccgttggcgggcgacctgcatcacgtcgtacaggtaggggctgtcggggatgccgcgcagctcaagtgtggtgctcccggaacgcagctgcccgcgcagccgctccccgatgtcgtagcggatcaggacggcggggagcggcaggcgttcaccccgggggttccagtgcgtccaggcgacgccgccttccccttcggtcaggacgacggcggccgctccggcggccgcggccgcgacggcctgctccgcgtagcgggcctccgtggcgtccacgagcaccgcggcaccggccggtttcaggccgcgtgcgcgcagtgccgcgtagtcctcggggcggccggtgcccgcgtcgagcagacgcaggctgcggcggccgtccacggtgggcgaggcgctcagcaggccgccttcgaggtcgatcgctcggcctgcccgcagcgagcgggcggtcagctgcggcgcggtcagctgccagcgggagttgaactcgaagtcaccgacggtcacttccttcgtcggggtgacgtacagacggcgggcgtcggcgctgaagtccatgtggccgttggagatgctgcgcccgcctacggcgcggtgggtgtagaagctgacgacggcttcctggacggccggcttggcggtctcgatccggacccggccagccttgcgggcgtcgaggaccacatgtctgtcgcggtcgaccgtcagctcggggtcgacgacgacgctctgcacgctgccgttctcgacgcggtcggagatcacgccgtgcaggaagtaggagccctcgggcaccgacacggtgagagtctccccgggccgcagggcggtgacgacgtcgtcgcgggagtgggggccgacgagcaccagcggagtgacccaggccgggcggccggagcggtcgacggcggtcagggtgagcttgtgccggggggctcccttcgacaccgcgagcacggtgtgcgcgacggtcttcccgtcgccgctcgtcgcggtgaggctgccgccgtaacggcctgcgggcagggacttcggggcgagggtgacggcgatcccggcccggccgcccgcggggacggtgac

SEQ ID NO: 4442 - DNA, 1432 bp, Unknown
  Kingdom: Bacteria, Phylum: Actinobacteria, Class: Actinobacteria, Order: Streptomycetales, Family: Streptomycetaceae, Genus: Streptomyces
gggccgggggagccctcggggtggatctcgactatgcggccgccgtcgagggccacatcggcgcggtaggagggcgcgccggtgccgtcgacgacgagcgcgtcacgcaggaccaggtccatgggtcacctttccgatcggggggcggggccgcggctctagaagaacgtgcggatgtagtcggtgaccgtgccgtccgccgtgaccagcgggatcagctgccacttgtcgaagctggtgcaggggtgcgagagacccatgccgacccagtcgcccacctccagctccgtgcccgcctccgtgcgcacccaggtgtgctggtcggagaggccggtgaccgtgaccccggtggcgggccggaccgagccgtcccggccggagcggaccacctgcgcctcgggcagatcgaggtcgtaggccgcgtcccgcttgcccgcgttcaggaacgcctgctcgccggagggacgggagacgacctgcgcccagaggcggaaggcaggctccagggcgccttcctcggggacgcggttgaacggggtgaggtgcttgtagtgcccgtcgtcgtgcgagacgtacgcacccgagcgcagcaacttcagcaccggcagactgagttcggggatctcggcgaagacgtccgcgaccgcgtcgaaccaggcgctgccgcccgcgctgatgacgatcccgtcggctgcggtgaaccgcttctcggcgtcgaaggaggccgcgagcccgacgagccgccgcagccacgcccgtacccgctcggggtcggcgtccggcacctcccactcgtatccggccacacccaccaggcgcagcgcggtggccgccgccaccgcgtcggccaccgccgcgcagtcggcctccgtgcgggccccggtgcgcgcgccctcgcccgctcccagctccacgaccacgtcgaccggacgggtggcgcccgccgcgcgcagggccgcctccatcagctcgacgccgcgcacggagtcgacgtaacagacgaagcggaactccgggtcggccgtcatctcgccggccagccagcgcagggcgacggcgtcgaccagttcgttggcgaggaagatccgcccgatcccgtacgcccggtagacccgcgcctggtgcggcacggccgccgtgatgccccacgcgccgcgcttcagctggtcgacgaagagctgcggggacatggacgtcttgccgtgcggggcgaacgcgaggccgtggcgctcggcgtacgtctccaggaggtcgaggttgtgcgcgaccgactctgcggagagagcgaggacgggggtggtgaacccgccggtgaagaggttgcgccgctcggccgccagggccccgacggtcaggccctccgcgtccggcggcagggccttgaagcggtggtcgacgcgttcgtcggcgaggccggacgcggagggcctga

SEQ ID NO: 4443 - DNA, 865 bp, Unknown
  Kingdom: Bacteria, Phylum: Actinobacteria, Class: Actinobacteria, Order: Streptomycetales, Family: Streptomycetaceae, Genus: Streptomyces
ctcgctcaccgcgccacgcccccggccggtgcgtcggccgtcccgttcacgtacaccctgggcacccgggagccgatgcgggtgacgatctcgtacgcgatggtgccggcggcctcggcccagtcctgcgcggtcggctcgccccggtcgcccggcccgaacagcaccgcttccgcgcccggttccggccggtcgccgccgaggtcgacgacgaactggtccatggcgacccggcccgcgaccgtgcgcaccttcccgccgaccaggacggggccggtgcccgacgcgtggcgcgggacgccgtccgcgtagccgacggggatcaggccgagggtcgtctccgtggacgtcgtgtagtggtggccgtagctgacgccgtgtccggccggggcgcccttgaccagggcgacggacgcggcgagcgtcatcacgggccgcagcccgaagtcggcgggtgtgcccagctcgggggcgggcgagatgccgtacatcgcgatgccggtccgtacgaggtcgaagtgcgcctcggggatcgtgagcgtggccggggagttggccatgtgccgcacctcgggctccaccccctccttctcggcgtacgccaccatgtcgcggtacacgccgagctgggcggcgatcgaggggtggccgggctcatcggcgcaggcgaagtgcgaccagaggccggtgaccttcacccgtccggcccgctcggcggccagcgcctcggtgaccagctcgggccagtcggcgggctggcagccgctccggccgaggccggtgtcggccttgagctggatcctggccgggcggccggcctccgcggcggcgccggccacctcgcgcagcgcccacaggccgctga

SEQ ID NO: 4444 - DNA, 2945 bp, Unknown
  Kingdom: Bacteria, Phylum: Actinobacteria, Class: Actinobacteria, Order: Streptomycetales, Family: Streptomycetaceae, Genus: Streptomyces
ccatgcctcgatcccggcccgctcctcctccggcagcgccaccgggaacgccgccgcctcctcccgtaccaccgccgcccgggacgtctggcggctcaataccccgagcagccgggtggtcccgtcccaactgagggtctccgcgctgtacagcggaccggcgaggaacgcctcggcgaacagggcgccgatcaggcgctgttcacccgcctccgccagcgcccggtgcaggccctcctcgtcgtgcacgatccacacggagcgcgaggaggtgcccgccgagtccttcaggaccgcgggcagccccactgcccgcagcacctccccggcgcctccgggacccggcgggacgggtacggccgtactccggctcagcccccgcgcgtgcagcgtctcccggacccggcgcttgtcccgcagcagccgtacggccgcgggatccgcgcccgggagccccagttcggcggccagctcggcggccggcaggctccaggtgtccgtcgtgttgatcagcccggccagcccgggcacggcggccaggacccgacgggtggcctccggatccatcgtgtcgacgtccacgacgtccagcgcgtccggcggcagcaccgccagctcgtgccggtagaccgagcggtcgccggtcagcaggcacagccggtgccccgcttcggcggcggcctccgccatccggcccaggccgaaggacagggactccagtgcggcgatcgtcatggcagcagctccacggtcggtacgggggaggggacgtcgccctcgacggtcctggcggcttccggagcgccgcgcccggcccattccatcaccgaccacggcggtcgcaggtcggccggcgacgcgatggtccggggccgcagcccggccgggtccagggcctcggcatgccgggtgaacacccgctccgcgtaccggtgtccggtgtcggcgcccagcaccagatgcagccgaccgggatcgcgggccgcctcccaggacgccgtcaggtgggccgccccggtggacaggcccgcgaacaccgcgtgctcccgcaacagcccgaccgtccccgccatcgcatggcggaagtccagccagtgcacggtgtcgtacagctcgtggcggacgttcccgaacggtatcgagctgccgatgcccgcgatgatcgcctccgggtcctcgaaccgctcgctcccgaacgtcacgctgccgaacggctggatgcccaccagccgcaccgaccgccccgactcccgcagcgcgcgggccagtccaccggtggaggcacccgtgcccaccgcgccgaccacggtcagcgggccctcgggcagcgccccggtgagcagctcggcgaactcccggtagccctcgtggtggacctggtcgtggtactgccgcatccagtggaagtccggccgttccgccagcagccggcgcacatggcgcacccgcagctcctggtccaggcgcaggctctgcgagggcggcatggcgtcgaccgtcgcaccgaggatctctaactgcgcccgcatggtggcgtccacggtggtggaggcgacgatgtggcagcgcagcccgtagcggtggcaggccatggcgagcgccagcgcgtagatgccgctggagctgtcgaccagggtctgcccggggaccacccggccccggcgcagcagcgagcggaccgcgccgagcgccgcgtacaccttcatcgtctcgaagcgggcgaggacgacgtcgccggtcagccggatcaggtccggggtcttcaccgcgtcggtgatgtgctcgtggaccgtcgcgacggccgggcgcggggacgtgtccggtcccgcggtgcgcggacgggcgtccgccccggccctcacttgcgccgcccgcgcacgatcagccggtccgagcgctggtcgtagccggacgcgtcgaacccgccgaagcactccacgtcggtgaagcccgcgctctcgaagagggcgtgcagctcggccgccgagtagagccaggaggtgatggacgccgtccgcgccgtcgtgccgcgcaccagcgtccagtccgtgcgcagccgacgccagctgtcgaggacggtgtcgcgctggacgacgtaggcgccgtcgggcaggtcgaccgccttcggccgcccgatccagcccgccagcacctccttgcccatcacgtcgaccaggagctgcccgcccggcgcgaggctctcgtacgcgttgcgcagcacctggaggttgtcctcggccgcgtcgaagtagccgaaggacgtgaagacgttcagcaccacgtcgaaggcgcccggctcccggtacacgagcatgtcggcgcgctccagccggacctcggcgcccgccgcgtcgcaggcggcccgggcgctctccagcatggagggtgacagatcgacccccgtcacctcgtacccgcgccccgccagcggcaccacgaagagacccggcccgcagcacaggtccaggactctcgtgcccggtgggaagtccagcaggggagaggacgcgaccagggcggccgcggactcggcccgcgccgccgggaacatcgtcggggcgaaatcggaccagagcgcgtcgtcctcgtaccagtgcatgcctcgcggcctcctcccgggcccgtgggcccgtgggtgtcctgctgccgtcgcaccggcagccgtgtcacgtcaccggccgccgcttccgtcaccggacgggttccgcgcccggcgtctctccagtagtcggccgccccggcggagaagttcccgcgcgatctccgggcgggtccggaggccgccgcccgccaccgagcgggcctcaccggcggcccgcgggcggtgtgcaggcgacgtaaccgtcgttgttcagctggtgacatccccgggtaacgggcccctcctagattcgggggtgaccgccgcccgccccgcgtccctccgggaacgcccgcccccgaag

SEQ ID NO: 4445 - DNA, 577 bp, Unknown
  Kingdom: Bacteria, Phylum: Actinobacteria, Class: Actinobacteria, Order: Streptomycetales, Family: Streptomycetaceae, Genus: Streptomyces
gccactgagtgaggtggccgaacggtggatctaccggtaccggccgtcaggtccggaggccgggcgcccggaggagttccggttcaccgtctggggccgctgcctggcctcgtcggacgggaagcaccgtgaactccgcctgcccgtgcaccgcatcggcgcggacgcaccgcccgagggtttcgtcgccgccacggctctggtgctggccgagggcgctccgggaccgctgccgaagcacgtacggatcgtcgagttcgcgcttctcgacggtcgtacgcgggagctcttcgccggaagcagggacgaggcgctcgcccgctaccgtgcacacgggccgggtgctctggccgagatcctcaacggccaggagtaccggcctggttcgtcgtgcgccgactgctcctacttgagtgtctgtccggccctgcgctcgacacccggactgctggggacggagtcggcgggccgtccgcgccgcacgtggtcggtgacgaacgggcgcaactaccgcgcctgccccgcccgtgaccacctgcgccggctgcggctgccgacggcggacgccgtcgagcgg

SEQ ID NO: 4446 - DNA, 1174 bp, Unknown
  Kingdom: Bacteria, Phylum: Actinobacteria, Class: Actinobacteria, Order: Streptomycetales, Family: Streptomycetaceae, Genus: Streptomyces
  misc_feature (400)..(401): n is a, c, g, or t
  misc_feature (780)..(781): n is a, c, g, or t
ggctgcggtccgtgctggacacccacggcccggacgcggtggccctctacgtctccggccagatgacgctggaggcgcagtacctcgccaacaagctggccaagggcttcatcgggacgaacaccatcgagtccaactcccggctctgcatggcgagcgcgggcagcggctacaagctgtccctcggcgcggacgggccgcccgggtcctacgaggacttcgcccacgccgacgtcttcctcgtcaccggcgccaacatggccgactgccacccgatcctcttcctgcggatgatggagcgcgtcaaggcgggcgcgaagctgatcgtcgtcgacccccggcgcaacgccaccgccgccaaggccgacctgtacctccggatccggcccggcaccgaccnnctggatcggtgaggcgggcgcatggatgagctgctggacgatgggcctcaaccagagcacccacggcacctggaacaccaacgcgatcgtcaatctgcacctggcgaccggagcgatctgccgccccggcagcggaccgttctcgctcaccggccagcccaacgccatgggcggacgcgagatgggatacatgggccccggactgcccggccagcgatcggtcctggtcgacgaggaacgcgccttcaccgaggagctgtggggcattccgcccggcaccctgcgcgcggacggctcgggcagcggcaccgtcgacatgttccggcgcatggccgagggggagatcaaggcctgctggatcatctgcaccaatccggtnncgtcatcgagggcctggaggccgccgaattcgtcgtcacccaggacgtgttcgccgacaccgagaccaacgcgtacgccgatatcgtcctgcccgccgccctctgggccgagtccgagggcgtgatgatcaactcggagcgcaccctcaccctctcccgccgcgccaccgacccgccgggagaggcctggccggactggcgcgtcatcgcggcggtggcctgcgccatggggtacgaggacgccttcggctacacgagcgccgaggagatcttcgccgagatcacccgcgcctggaacccgcgcaccggctacgacctgcgcggagtgacgtacgagcggctgcgcgacacccccgtgcagtggcccagcgccgccgtcgacggccccgcccg

SEQ ID NO: 4447 - DNA, 790 bp, Unknown
  Kingdom: Bacteria, Phylum: Actinobacteria, Class: Actinobacteria, Order: Streptomycetales, Family: Streptomycetaceae, Genus: Streptomyces
gcccgggtgcgtccgcggcgctccaggcgatccgcggcggacgcacccgggcgcacagcggctgtcccttggcgtcggtgagcccgagccgcccggtgaggcgtccggagcgtgcggcggcttcgaggacgtccggatcgatgtcggcgaacatcagcttggcgcgccggaacatggtgaagaccccggcgtcgtccaccgttccccacgacagatagacgaaccgcccgcccagccggttctggacgtagggccccgccacctcgatcccgtccgccgtcgcggtggccgtgcagtcgagcacccacgaggcggaggaggcgtcccccgggtgcaggccgagcagctcgtccggccggtccttgcgctggacgccgacgtggatgttcgcgtaccccgggaagtcgctgtccgggccgcagctgcggccggggagggctgaggcctcgatatggatctgcatgcccccatggtccggcacggccggagcgggcggccccgccctcccgtgcggggtgtctcacacggcgtcctccggagcgccgtcgtacaccgcgcccagctccctcatcagctcctcgtcgaccgcgaacgcggtgccgtcgatccgccgcaccggcgcgatgccctgcgagttgcagacgaaggcggccggatagctgcccaccccgtccgggccctccagcgtcaccgggcggcgcaccggcggccgtccggcccgcaccagctcccgctccagcagcgtcatcgtgatgccggcgagcgccggggcgccgggccacaccacgga

SEQ ID NO: 4448 - DNA, 999 bp, Unknown
  Kingdom: Bacteria, Phylum: Actinobacteria, Class: Actinobacteria, Order: Streptomycetales, Family: Streptomycetaceae, Genus: Streptomyces
  misc_feature (589)..(590): n is a, c, g, or t
tcgccaccggtggccgcggcccgcagggcggccgtgccctcgtcggaggcgaaccaggagcggaaggcctcccggggcggagccggggtgtcgcggctgtcgctccagccgctgagcggtgggggcagccgcgcgatgatgccgtcgcgccccgcgatgacgcggccgagcccggacgccttctgtgctgccgtgtacagggccgggcggcgcatcacggcggcggccgccttcatcgccagtttctccggtgtgacgccggtctgttccgtgtgctgatggcgcaactccaccagcagcgacggaatatcgatcttcaccgggcaggcgtcgaagcaggccccgcagaggctggaggcgtacggcagggagctgttcgggtcgtccttcgcagcgtgcattcccgccagttgcggagtgaggacggcgccgatgggtccggggtaggtcgacccgtaggcgtgaccgccggtccgctcgtacaccggacagacgttgaggcaggcggagcagcggatgcagttgagggcggcgcgtccgatcgcgtcggcgagggcggcggtgcggccgttgtcgaggaggatcaggnngctcccctgtggaggagcggggcaggagctggaggaagacctccaggtcctggtagcgcggaatcaccttctcgacgcccatcacggtgatgagcgtctcgggcagggtcaggcacatgcgtccgttgccctcggactcgacgacggcgagcgtgccggtctcggcgacaccgaagttggcgccggagacggcgaccttcgccgagaggaacttctcacggaggtagcggcgggcggcggcggcgaggtgggcggggacgttgtccaggtccgggtcgatgccggggatccggtcgaggaagatctgccggatctcgtcccggttgcggtggatcgcgggcaccaggatgtgcgagggcttgtcgtgggcgagctgcacgatgagttcggcgaggtcggtctcgtgcgg

SEQ ID NO: 4449 - DNA, 503 bp, Unknown
  Kingdom: Bacteria, Phylum: Actinobacteria, Class: Actinobacteria, Order: Streptomycetales, Family: Streptomycetaceae, Genus: Streptomyces
  misc_feature (197)..(315): n is a, c, g, or t
gcccagccggtgcgccagggcgctcgtcccggccggttcgtccagcgcgcacagcacatcggcccggacccggccgagcagccgggcgagggtctccggagtccggtcgcctgactcgctccagagtccgccgatgccgcgcgccgggtagatcagtcccggctgccagggctcctcgtggcctcccaccacctccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngactcacctctcccagcagttgttcgagcccgccgtccgcgagccgccgggagtggtaggcgatgtccgcctccagcagcgcccgcagccggggccagtacggctcgatcagcctctgccaggcccgctccagcagatcggcgagctcgtgcacggcccgcgccggatcggccagcagccgccgcccg

SEQ ID NO: 4450 - DNA, 489 bp, Unknown
  Kingdom: Bacteria, Phylum: Actinobacteria, Class: Actinobacteria, Order: Streptomycetales, Family: Streptomycetaceae, Genus: Streptomyces
  misc_feature (109)..(278): n is a, c, g, or t
gggcggggctgtgggcgatcgtgcggccgggtccgtacatctgcgccgagtgggagaacggcggacttccggtgtgggtgacgggccggttcgggcggcgggtgcgtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcgggggcccgggaggggttcgaggtgctgcgccggcatcggccgaggggaccgctgatgtgcatggagttctggtgcggctggttcgaccactgggggtccgcgccggtgcgccgggatccggagcaggcggccggtgcgctgcgggagatcctggagtgcggggcgtcggtgaacatctacatggcgcacggggggacgaacttcggg

SEQ ID NO: 4451 - DNA, 549 bp, Unknown
  Kingdom: Bacteria, Phylum: Actinobacteria, Class: Actinobacteria, Order: Streptomycetales, Family: Streptomycetaceae, Genus: Streptomyces
ccctgcgcgggctgctggcgctgtggacgctggcactgatcctgcccgcgctcgcgccgagcctggtcacgctgtgcgcggcgctgttcgtctacggcgcgacggccgggatgtccgacgtggcgatgaacgccctgggcatcgaggtggagaaccgtctcgacaagtcgatcatgtcgggcctgcacggcatgtggagcgtgggcgcgctgatcggttcggcggcgggcaccgtcgccgcgcacaccgcgaccgatgcccgactgcaccacgccatcgccgccctggtgctcacggccctggggctggtcgcctgccggggggtcctcgatctccagagccgcccggacgaggagccgccgccgcgtttcacgctgccgccgaagtcggccctgatcatcggggcgatcgggttctgcgcggtgttcgcggaaggcgccagcctggactggtcggcggtctacctgcgggacgtcctggacagttcggacggtctcgccgcggcgtccaccacggcgttcaccctgacgatggccctggcccggatcg

SEQ ID NO: 4452 - DNA, 600 bp, Unknown
  Kingdom: Bacteria, Phylum: Actinobacteria, Class: Actinobacteria, Order: Streptomycetales, Family: Streptomycetaceae, Genus: Streptomyces
gcgcccgacgggcggtgcgggcgcgtgagcctggcgccccgggcggtgctcgtccaccggcggacggagtacgaggagctgctcgcccggcacgggacgcacggacaggccgcgttcttcctgtccagccggggccgctcgatcgacgaggtggcacgccgccacgaggacacccggcaggcgctgcgggaggtggcggcggcggtgccgctcacctggcgcagctcccgagtggagcgggcggacctggaccgtttcctgttcgctccggaggacgtggtggtcgtggtcggccaggacgggctggtcgccaacaccgcgaagtacctgtccgggcagccggtggtgggcatcgacaccgacccggggcgcaaccccggggtcctggtccgccaccgccacgccgacgcggccaccctgctgcgcgccgcgaccgccgccggagggagtgccgaggagctgaccatggtcgaggccgtcgccgacgacacccagcgtctcctcgccctgaacgagatctacctcgggccgcccggccaccagacggcccgctaccgcctgggccccgacggcgagacggcgcccggcgaagcccaggcc

SEQ ID NO: 4453 - DNA, 1219 bp, Unknown
  Kingdom: Bacteria, Phylum: Actinobacteria, Class: Actinobacteria, Order: Streptomycetales, Family: Streptomycetaceae, Genus: Streptomyces
ccccaccggcggtccggggtgtcgcctacaggtcgaactcgtgcggcggcaggtcgagcgcgaagcacgcctcccgcacgacggcctgctcggacgcgtcgaagtcgccgtcggcgccgccgatgacgatgccgatctggaccacggcgcgggcctcggccggcttcttcttcgccttggcgatctcctggaccacgctgaccttgccgaacgcgaagtcggcggtgagctggtcgacgtaggcgttgaagcgacgctgcaggtcgtccgcggggaagttccgcaggacgtcgttggtcgagatgagcgtcgccacgcgctggcgctccgacgggtcgatggaaccgtcggcggcggcgacgagcgcgcacatggccatgctcgcgtcccggaacgaccccgacttcaggtcgttcttcttcgcctccagctgcgtctgcatcgacgacgcggattccttgatgcgatcccacagagccatgacatctccctacgttgcggtgcgaacccggaaccgatgcaactctacaggtgtgtagaggtcggtggccggggtgtctgccacgacgaagcccccggacacggtgccgatgtccgggggcttcgaaacgggccgcgagcggcagcggctggaagcggctactcgcgcgtctcgcccgccggttcgggggtgaggtcgtcgtgcgacggcagccggcgctcgggagcggacttcgcgacgggctccttctccgtaccgctcgtgtccttgttctttccgtccccgccgccgcgacgggcctcgatcctcgcggcgatgggctgcgtccaccgggcggtgagcgggccgacgatgacgaggatcaggacgtacgcggtggcgatgggtccgatgcgcggctcggtggccacggcgaggccggcgatgacgatggagaactcgccgcgcgccacgagggtgccgcccgcgcgccagcgaccgcgcgggccgaccccggcgcgccgggccgcgtagtagccggtggcgatcttggtgatggtggtgatgatggccagcagggccgcgggcagcagcaccggcgggatgtcggccgggttcgtggagagtccgaagaagacgaagaacacggcggcgaacaggtcccgcagcggggtgagcagcttgcgggcgccctcggcgacctcgccggagagcgcgatgccgacgaggaacgcgccgacggccgcggacacctggagc

SEQ ID NO: 4454 - DNA, 615 bp, Unknown
  Kingdom: Bacteria, Phylum: Actinobacteria, Class: Actinobacteria, Order: Streptomycetales, Family: Streptomycetaceae, Genus: Streptomyces
gccgtcgacggccccgcccgcaaccccgtgcgctacgtcaacgacggcgtcagccaggagctgaccgtacggcccgacgggagcgtgccgaggctcgccttccccacgccgagcggccgggccgtcttccacgcccgcccgcatctgccgccggccgaaaggcccgacgaggacttcccgcatctcctcaacaccgggcggctccagcaccagtggcacaccctcaccaagaccgcgaagatcgccaggctgaaccggctggacccgggcccgttcgtggagatccaccccgacgacgcctcggccctgggcatcggcgaggacgacggcgtcgaggtcgcctcgcggcgcggccgcgcggtgctcccggcccggatcaccgaccgggtcggggtgggggagtgcttcgccccgttccactggaacgacctgttcggcgagtacctcggcgtgaacgccgtgaccaacgacgcggtcgacccgatctcgttccagcccgagcttaaggtgtgcgcggtccggctgacgaaggtcgccgcacccgtgccgcgccacggacccgccgaggcggcacgtcccgcgctcaccggtggccccggtcccgcggacgccccg

SEQ ID NO: 4455 - DNA, 1352 bp, Unknown
  Kingdom: Bacteria, Phylum: Actinobacteria, Class: Actinobacteria, Order: Streptomycetales, Family: Streptomycetaceae, Genus: Streptomyces
ggtcccgcaccaccagcccgccgcccgtacaccccggcgcgggcgcccacacctccagctccggaccgccgtccgcaccccgcaccggaatcaccgcgcccgccctcgccagcaccggcaccctcgacagcggagcgtcgaccaggacctggcccggtccttcgtacgcccgcccggtcgccgtgtcgtaccaccgcccccgcggcagccgcaccgcccgccgccgcgtcccggcctccagcaccggagccaccagcagcgcgtcgcccagcaggaacgcgtcctcgcactcccgcaacgcccggtcgcccggcgcaccccaccacatcggccgcacatagggcgcaccggtcatccgcgccacctgcgacagcgtcacgaagtacgggtgaagccgctcccgctccaccagcgccgccctcgcgtgctccagcacctcaggaccgaactcccacggctcccgccgccccgcgtcgatcgccgcatgggtccggaacaacggcagatacgcccccagctggaaccaccgcagatacagctccggcgacgggaacccgtcgaacccgcccacatccggacccgaatacggcaccccgcacagcccgagccccaccaccagcgacaacgacgcccgcagccccggccaccccgtcgacacatcaccggaccaggtgccgccgtacctctgcatccccgcccagccggaccgcgagaagaggaacggccgctcctggggccgcagccgcagcaacccctcgtaccctgcccgcgccatcgccagggcgtacacgttgtgcgcctcccgatgatcaccgccgacgccctccagcacgtgtcgggccgaacgcggcagcgacggatccccgaacgccgcgaacgacaccggctcgttcatgtcgtgccagacccccgagaagccctgcgcaagccgttcctcgtacagagatccccaccaatcccgcacaagcggatcagtgaagtccggatagacgcaagcacccggccacacctccccgaccaccacccgcccccgagcgtcccggacgtacgcaccacgctccccgaccgccacgcccccgtcgaacaccgcgtcgccgggctccgactgcaccgccggatccacgatcgacaccagccgcaccccgtcctcacgcagctccttcgccagcgcgggcaacgcggggaaccgcgcacggtccacggtgaacacccggtgcgcgtcgtagtggtcgatgtccagatgcagcacggacagcggcagcccccgctcccggtacccgtcgacgacccgccgcacctcctcctcgctgccgaacccccaccgggcgtgctgcggccccagcgcccaggac

SEQ ID NO: 4456 - DNA, 665 bp, Unknown
  Kingdom: Bacteria, Phylum: Actinobacteria, Class: Actinobacteria, Order: Streptomycetales, Family: Streptomycetaceae, Genus: Streptomyces
acggggtctccatcccgtaccggtagaagttccggtaccagggcgccggtccgtcggccttctcggcgaacaccaccagtcggcgaccgctgtcgatcatctcctccagggtgggccacggggcgtccgggtccgccgagggggtgtgcaggagatcgtccaggcccgcggcgtggaacgcctcctcggtgtcctcgggactgatgtcgtcctggacgatgagcgtcacgatctcggtggggtgggcgtgcagccagtcgccgatgtcctccagggccgggaccagttcgatggctccggcgcggcagacaccgtggcagagccagaggccctcgcgcggcgggttgaccttgtcgatggctccggagatcaggcgccgttgctcgggggtgaattcgggggagtcgaggcgtgcggcgatgtcctgcggtcgctcccagcggtatgtgttcgagctggagggcccggacgcccgtgttgagctgggtggtgatgtcggggtcctggagggggccgatgaaccggtccgcggtggtggacatggcgttgtgcgaggtgaggtaggcggcttcgtcgtagcgcagttcgcacaggcggctgctgcccaggcactggcggggtgcggacgggccgaacgcgggtggcacgagcaggacgccggccag

SEQ ID NO: 4457 - DNA, 651 bp, Unknown
  Kingdom: Bacteria, Phylum: Actinobacteria, Class: Actinobacteria, Order: Streptomycetales, Family: Streptomycetaceae, Genus: Streptomyces
ctgcccgggaccgtcatggctccggccggcggcacgggcggcggccggggcccgagagggttcgggggcggagcggacggccggcccgagctcacgacggcctgtcggctgacgatgggcctcggcatgttcgccatgctgctcaccctgtgagacgggaagtgggacagaacccccggcacaccgtggtctgcgtcacttgccggtcgaggccgtacccccggtcgacccgcccctcctaagctgaagccatgctggtctccctcgcgctgctcctgctcggtgcattgaccgccctggtgactccccgcgtgatggcgcgcgcccggtggccggagcgcgagccggtcgtggccctgtgggtctggcagtgcgtggtggccggggtcctcctctcgttcgccctgtccatgacgttgagcgcggccgccgcctggcaggcggtgcgcggccacgtcttcgctcccgccccgcacgccgtcgtcgaggcgtacgccctggcggcgtacgggccgtggtcggccgtcgtcgcggtgctgctggcgctgggcggactgtggaccggggcgatgctcctgagggagatccggcgggcgcggcgtcgccgccagcagcgccgggcggaactgctggtgcgtgccccgctgatgc

SEQ ID NO: 4458 - DNA, 699 bp, Unknown
  Kingdom: Bacteria, Phylum: Actinobacteria, Class: Actinobacteria, Order: Streptomycetales, Family: Streptomycetaceae, Genus: Streptomyces
ggaccctcgggggaggccgccgtcccggccgcgccgcgtgccgtccccgccacggagtttcctccggccgcatcgcggtgcgtggtcatggccggtacgcccccggccgcgtcacctgcggtcgtcatcgccggtcctccggtgcgggtgcgaagggggccgccacggacgccatgtcccgtacgggctcgaagggagccgtcaccgacgccatgtcccgtacggccgacggctcgcgaccgccgcccctctccggtgggacctcggccggcccggctccgtccggatcctccggggtgagcagttccgcgatgtccagcacgtggtagccgcgcatcgagggcaggcagctgccccggaccgggccgatcgcgcccgcccagtccggcgggatggcgctctccccgttcagcgctccggccagtgcgcccgccaccgccgccgtcgtgtccgcgtcgcggcccatgttgacggccgtgagcaccgccgtccggaaatccccgcgcgccgccgtgaacgctccgaacgccaggcccaccgcctccggtgcgaggtcggtccacgggtagccggcgattaccaccgccgagcgcaccgcccgctccatcgtgagccggtccgggtagggccgctgggccgccgccaccgcccggcgcagcgaccgggccgtccaggagtccatcgggaccaccgagagcg

SEQ ID NO: 4459 - DNA, 547 bp, Unknown
  Kingdom: Bacteria, Phylum: Actinobacteria, Class: Actinobacteria, Order: Streptomycetales, Family: Streptomycetaceae, Genus: Streptomyces
gccaccactcggtcgcctcgatcgtggcggtcggccggtgggccaggacctcggtgacggccttgaggtccagcagcagcgcgccgccgctcgccaccgggtccggggcgccggacgacccggcggccccggtggtcggcagccggcgcaccgactccgccagggtcacccggaccgtgttcccggccagggtgacgtcgatctcgtcgcccagtttcgcgttcgtgctcttcagataggcgtccgtcgcgaccgccttgaccgcggcggccttcggccgggcggcggtgacccgcagggtgccggaggtcggctcccagttgtcctcgttgtccacaccggtgtcgtacgtgaagtcgggcaggctcggcgcgccgttgcgcaccggcggcttgcccggccggtcctcgccggcctcggtgagcgtcatggccgcgtcccagcgcatcgactccggggccggcaccgggcgttcggcgcccgacccggcgacgacccgcacgtttctcaccgagacccggtgcttgcgcgcgtagtcggacggcgc

SEQ ID NO: 4460 - DNA, 547 bp, Unknown
  Kingdom: Bacteria, Phylum: Actinobacteria, Class: Actinobacteria, Order: Streptomycetales, Family: Streptomycetaceae, Genus: Streptomyces
  misc_feature (200)..(322): n is a, c, g, or t
gccgggtcccggacggcctcgacgaggaacgggagcacctcgggtgccgcgggacgcaccgaaccgccgtcgccggagcacgcgaagtgaagggcggcgtgggcgttatgggccgttcgcagaccgggggaccagagccgctccagcagatccggcccgtactgcccgtccggcagggggatggaggggtcgaccacctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngccgtccccctccccggccccgtcgacatcaccctggacaccgaggagctcaaggactacgcccgctgatccgccaccacccggccgctcacctcgctcacccggccggccccgctcaccgcgcgtccgccgccagttgcgtcgtcgccagctcgcggtacaggtcgtccccggcgatcagctcctcgtgcgtgcccgccgtgcggacccggccgtcctccagga

SEQ ID NO: 4461 - DNA, 1116 bp, Unknown
  Kingdom: Bacteria, Phylum: Actinobacteria, Class: Actinobacteria, Order: Streptomycetales, Family: Streptomycetaceae, Genus: Streptomyces
accagcgagatcgacaccagcttcagcgtggagaccacgtcaccgaggaagaccatgccgtagatcgccgttccggccgctccgatcccggtccacaccgcgtacgccggaccgacgtccagtttccgcagcgccagggtcagcagaccgaagctgccgagcgcgaacgccgcgaacgcgatcgtcggccagagccgggtgaatccgtgcgagagcttcagacacacggcgaagccggtctccagcagtcctgcgaccacgaccagcagccacgccatcgtcagttgcctcccgcataggtgacggcttcgtcccactcggtgcgattatgcctttaccagtcgttgaagcccgcaaacatgcccgcgccgccgcggccgattccggccggaggcaccgtcagtcgccctcgcgccgttcccgggtcgcgagcagccggcgcagggagtccagccgtgccgggtcggcgtgtccctccgccacccaggcgtccagcgcgcactccggctggttctcgtcgtgggtgcagccgcgcggacagttctcggtgcccggctgcaggtccgggaaggcgttgatgacccgcgacgggtcgacgtggtgcagcccgaaggaccgcacgcccggggtgtcgaccacccagccccggtcgccgggcagcggcagcgcgagagccgaggttgtggtgtgccgcccccggccggtgaccgcgttgacgatgcccgtggtccgccgtctgtccttcggcaccagggcgttgaccagcgtcgtcttgccgactccggagtgcccgacgaaggcggtgacgcggtcgttgaggaactcccgcacctggtccgccgcgtccccgctctccagctcctcgcggctggtcacgatgtacgggacgccgagtggggtgtacgcctccagcagcttgtccggagaggccaggtcggacttggtcagcaccaggagcggggtgaggccgccgtcgtacgccgccaccagacagcggtcgatcatgcgcgggcggggctccgggtcggccagcgcggtgacgatcgccagctggtccgcgttggcgacgaccacacgctcgtacgggtcgtcgtcgtccgccgtacggcggagcac

SEQ ID NO: 4462 - DNA, 995 bp, Unknown
  Kingdom: Bacteria, Phylum: Actinobacteria, Class: Actinobacteria, Order: Streptomycetales, Family: Streptomycetaceae, Genus: Streptomyces
gccggtaggcgtccgcgacgatgccgcagtgctcgtcgacgaagttccacacgtcggcggcgacatggacgagcagccgtacgtcgtcggggtcgcgccgggcggtctcgtccacgaggtcctgccagaccatcgcgccgcccatccggaaggcgtgcaggacggcgtcgagcggcacgccctgctcggcgcggatctcaccgatccagcgggaggtgcggtgggcggactcccggaactcccggggctggatcagggagccgacgttgtgccgcagcgagtggtggacctcccgccagacctcggcccggccggagtcgatggccgcccggtagccgggctcctgggcgtacagggcttccacgagccggtcggtgagggccggcagcgaggcgacgaggacccgggcggcccggtgcagcacctcgacggcctcgcggtcggccagggaccggaagcggggcggcaacggcgttgccggggacgggccgtgcagcgccccgatccgcgaacgtacgacctgtggcatggcggcctccaccgggaatcggcctgccgcgcgagcggcgggcttggcgcacccggcccgggcggggcgcgagtgcggcgacacgatcctgacgcccgcagaatggcataccgcccggtcggtacctaggggtctgcgcggaactcgtcatcacggtctcgcaacctggaacgcctcgggcgtcctgatcctggtggcgccgtggcaactcgtggtcgctgtcaccgtcgagagccggacgccgggggcccggtcaagatccgccgggcacgccctgagggcccagcagccgggccagttcggtgcgggagcggatgccgagggcggcgaagacattgcggaggtggtggtcgaccgtgcgggggctgagcgacagccgaagcgccacctcccggttggtggccccctcggcgacgcagcgggcgatgcgctgctgctggggggtgagcgccgccagcggttcgtc

SEQ ID NO: 4463 - DNA, 568 bp, Unknown
  Kingdom: Bacteria, Phylum: Actinobacteria, Class: Actinobacteria, Order: Streptomycetales, Family: Streptomycetaceae, Genus: Streptomyces
cggtccacgacgccgtcgccgatcaggcgcacggcccggccgacgacgtccgcgcggacgttccactcggcggagcccggcacggcgtccggacgacagcggcggcaggcccggaagccgcccgcctgggccgccgccgcggtggggtagaagcgcacgttgacgcgtttgggcgtgacggcggggcagctcggccggcagtagatgccggtggtcacgacggcgaagaagaacgcgccgtcgaatcgcgcgtcgcggctgctgaccgcctcgtaccgggtccgttcgtccatcacaccgtccagtgtgcggcagccggggcagccggggctgccgcactcgcggctttcggacgtcgaaccggtctccccgggctaccgcacccggccgcgctttgcctgcatggcggcccgcccctccgcacccttgcgcttccagttccgcaggatctcggagcgcacccgggcgtcggtcttggcgacgatccgctggttctcgcggatcagcttgcggtagctgtcgagccgccgctcgggcaggaccccgtcctccagcgcgccgaggacgg

SEQ ID NO: 4464 - DNA, 991 bp, Unknown
  Kingdom: Bacteria, Phylum: Actinobacteria, Class: Actinobacteria, Order: Streptomycetales, Family: Streptomycetaceae, Genus: Streptomyces
gcccgtaggcggcggcgagcgcaccggccagcgtgtagctgccgccctccgcccgggtgaacagcacgatcgcgatgtgcgcggtgccgttgggcagccgccccaccagggtgcccgtcagcagccgggcggcatgccgcgcccggaggatgtccagatatcctgcggccatgtccgcccctctccgccccggccgactgcgccgtctccgaggtgttacgtataacgtcgaggttcatacgtaccatgtgcgcagttcgcgggtccacctcgcggcgttacggaaacatcccgcacggaggcacgagtgaccagcgcgcagcagcccgtccccgcccggcccaccagccgcgacgtggcgcgtgcggcgggcgtctcccaggcgacggtctccctggtgctcggcgagaagtggccgggcagggtgtcggaggccacggcccagcgggtccgggacaccgcggcggagatcggctaccggcccaatctggcggcccgcagtctgcggctcggccgcaccaggaccgcgctgctggtggttcccgcgctcaccaacgagttcttcgcgcgggtgtacgccggggccgcggcgctcgccgccgaccacgacttcggcgtggtgctctacccctcgcccgatggcacgggtccggcccgggacccgttcgcctcggcccgcgccgcgctcgacggggtcatcgcgtcctcgatggcggccgacgcgctgggcgcgctgcacggggcggatctgccactggtgatgctggacagcgatccctcggacaccgggcccgccgcccgtgtgaacctcgacatcgccgacgggatgcggcaggtgacgggccatctgctggggctcggccaccgtcgcttcctgcatctggcgtccgccgtggacacctggacgttcgccgtgcgtgccgaggcgctgcacgacgcgctgggagcggcgggggacgcgacggttcgcacggtgcgcgccccgctggac

SEQ ID NO: 4465 - DNA, 1193 bp, Unknown
  Kingdom: Bacteria, Phylum: Actinobacteria, Class: Actinobacteria, Order: Streptomycetales, Family: Streptomycetaceae, Genus: Streptomyces
gtcggggaagcggtcggcgagcagatgtgccgcccgcagcgccagcgccgacttccccgccccggccggacccgagacgaccaccacgcgctcctcgccgcaacccagcacctccaggagttcccgcagttcgccggggcggccggtgaaggccgcggtgcaggcgggcggcgccgccggactcaccgcctcccgcgcgggggcgggccgccgcgcctcgcgcccccgtccgagcatcgagcggtacagcgccgccatcgccggactcggctccagccccagctcgcgtgccatcagctgccggtagtcgtcgtacaccgccagcgcctctgcctgccggcccgactggtgcagggagttcatccacgcggcccggagccgctcccgcagcggatgccgctccaccaggtcccgcagcccgtccaccgcgacggcgggccggcccagctcgatctcggtctccgcccagtcctcgtagacggtcagacatcgggcctccagccgaccggcctcctcggcgaccccggcggagtcccgcaggtcgttcagcggaggtccctcccacaggtccagcgcctcgcgcagcagccgggccgcaccggtcagatcaccccgcccggcggccgcccgccccgcgcgggccagcgacccgaagcgcagggtgtccagctcgccctcggcgatccgcagcagatagccgccgcagccgtgcaccacccggtcccggccctcgtgcccggccggccccagaagggtgcgggcggcactgacgtacacctggaggttcttgcgggcggtacgcggcggatcgtccggccacaccgcgtcggtcaggacctccaccggtacgggggtgttggggcgggacagcagcgtggcgaggacgaggcgctgcttccgcgggccgagcggcagctcctggccgtccagccgggcggtgagcgggccgagcagggagaagtacaccgcacccgcgggagcggtgcggacgggaggtcgggtcatcagcgggcctccggaacggggacgggcggcggtctgggccgtacgcacgccccgatcctgctgccgccccggcccccgcacatcggggccccgcacgcattttccggccggacacccgaccgaaacggcccgctgcccccatgttgcccgacccggcccccacgacgggcccacggcgggccctcatc

SEQ ID NO: 4466 - DNA, 638 bp, Unknown
  Kingdom: Bacteria, Phylum: Actinobacteria, Class: Actinobacteria, Order: Streptomycetales, Family: Streptomycetaceae, Genus: Streptomyces
gggttcgagtccggggagccgggcggagaggacgagggccggggccccggcctcgacggcgcaggcggcggcgagcgcgacggtgcccggctcgggcagtccgtgcgcggcgagcagccgggccacgaagaacaggaccccgagggcgacggccgcgacgggcgtcccgcctccgccgaggccgaggtcggccaggtacagcaggggcagcagcgcgccgaggaagagggtgacggccgccaggagcagggggcgcacacccgcgccgaactcctccagggcgcggctgccggtcagtttgcggtgggcgtggacggtgaagaggtgggcgcaccaggcagccggggcgacggcggcggcgaggccgagcagcggggccggggtgccgtcccacgggccgtccggaccgccggtcatcacctgggcgagcagttcctcgccgtacaccgcgtagctcagcagccagcagccgtacatcccggcgcggcccgctccttcgggggcgcgcaggggaccgcggcccaggcacgcccggagcgccaggcaggccaggacggcgccgacgacggtgacgagcgcccgcgtcccgtcgccgaggacaccctcggtgacccggagcaccccggcggtcgccaggc

SEQ ID NO: 4467 - DNA, 1105 bp, Unknown
  Kingdom: Bacteria, Phylum: Actinobacteria, Class: Actinobacteria, Order: Streptomycetales, Family: Streptomycetaceae, Genus: Streptomyces
gcatacgctgcacgcgctgaccggcgccgcgcagcgtatgcgcgacggggagcagccggagtcggtgcccgtctcgggggacgacgaggtcgggcggctggccgcggcgttcaacgacatgtccgcgcaccgggcacggctggaggagcagcgcaaggccatggtgagcgacgtcgcccatgaactgcgcaccccgctcagcaacatccggggctggctggaagccgcccaggacggactcgccgaccccgacccggcgttcgtctcctcgctgctggaggaggccgtgctgctccagcacatcatcgacgacctccaggatctggcagccgccgacgccggggtgctgcggctgcatcccgaatccgtcgagatccgggaactgctgagccaggtcgccgccgctcaccaggcgcgggcggagaacgcgggcgtcacgctcgccgtcacggccaccgcgccggcgccggccctgcgcgccgacccggtcaggctccggcaggcggtgggcaacctggtgtccaacgccgtacgtcacacgcccgatggcgggcgggtgacgctgcgcgcgtacacctccgaggagggtgacgggacggtgctggttgaggtgacggacaccggatccggcatcccgcccgaggaccttccccacgtcttcgaccggttctggcgtgcggagaagtcccgcagccgccgcacgggcggcagcggcctgggcctcgccatcgtccgcaaactggtcgaggcccacggcggcacggtggacgcgacgagcgtcgagggcgaggggtcggccttcgtccttcggctgcccggaacgacgccgtccggcccctgatgggatgaccacagcgttctgacagcttcttcatatctccgcgccagcctggcggcatgccccgtccccggtgcgaaccggtatccgggaccgtcacggggccgagtatggaatggagacatccgtatgaccgctttcccctctcgccgcaccctgcgtgccgccgtcctggccgctgtcgcggccggcgcggtactggtcccgtccgccgccgccttcgccgacgcctccccgaagccgtcggagcccgccgcggtcgacctg

SEQ ID NO: 4468 - DNA, 944 bp, Unknown
  Kingdom: Bacteria, Phylum: Actinobacteria, Class: Actinobacteria, Order: Streptomycetales, Family: Streptomycetaceae, Genus: Streptomyces
ggcggcccgcggtgagggcgctgcacgtcatcaccggactcggggtcggcggcgccgagcggcagttgcggctgctgctgcgtcatctgccggtggagtgcgatgtcgtgacgctcaccaacccgggggcggtggccgaggagctgcggtccgacggcatccgggtgacccacctcgggatgcgcggcaaccgggacctgtcggccgtcggaaggctggcgcggctgatccgggacggccgctacgacgtggtccacacgcatctgtaccgggcctgtgtgtacggcaggatcgcggcccgcctcgcggggacccgggccactgtcgcgaccgagcactccctggggcgtgccgagatcgagggccgcccgctcacccggggtatccgtgccctctacctcaccaccgaacgcctgggcgcggcgaccgtcgccgtctcctccaccgtggccggccggctgcgggactggggggtgccggccgaccggatccggctggtgccgaacggcatcgacgcggaccggttccgcttcgacgcggagcgtcgggcatccgtacgggcggaactgggcatccccgacgcggcgttcgtcgtcggcggggtcgggcggctggtgccgggcaagcggttcgacgtgctgatccgcgcggtggccgccctgccggaggcccgcctgctgctggccggggacggtccggaggccggagcgctgcgggcgctggccctgcgcctcggggccgtggaccggatccggttcctcggggagtgcgacgaggacggggacggtccggtcccgggtgttccggcgctgctgagcgccgtggacacgtttgtctccacgtcccgcgaggagtccttcggtctcgccgccgtggaggcgctcgccgccggactgcccgtgttccacgacgcctgcccggccatcgacgacctgccccccgcc

SEQ ID NO: 4469 - DNA, 1015 bp, Unknown
  Kingdom: Bacteria, Phylum: Actinobacteria, Class: Actinobacteria, Order: Streptomycetales, Family: Streptomycetaceae, Genus: Streptomyces
gatgtggtcggtgccgaggcggcgcagcgatgcctcggccgcgcccttgatggtgccggcgctcaggccccggtggtcggggtgggcgccggccttggtggcgacgacgatgtcggaccggttggagcgggaggcgagccacttgccgatgacggtctccgactcgccgccctcgttgccctcgacccaggcggagtacgcgtcggcggtgtcgatgaagttgccgccggccgcgacgtacgcgtccaggacggcgaaggactggtcctcgtccgccgtccagccgaagacgttgccgccgagggcgagggggaagacctggaggtcggaggtgccgagagtgcgcggagaagtcatgtggagtgtcaacgggccggggcgggggtgatattccgtcgcccggtcgggccgtaccgtccccggacagaccggcagccctgacgtcggggggtgtgcgtcagggctgccggggttgcgggtcggcgacggaggacgtcggccggaggggcgggaggtcagacgttgaggcccttgctgttcagccaggccatcgggtccatcgcgctgccgcccgcggtgcggacctccaggtggaggtggacaccggtcacgttgccgctgtcgcccatgcggccgatggtctggccggtggtgaccttctggccgacggagacctcgatcgaggactggtgggcgtaccagatctccgtgccgtcctcgagctccaacaccgtgcggtagccgtacgagccggagtagccggccgacgtgatcgtgccgctgtgcacggccttgagcggcgcaccggcggacccggcgaagtcgaggccggtgtgctggcccgaggaccagagcgcgccggactgaccgtaggtcgaggtgatcgtgtacgagaaggtggggagggagaagctggcggcgagcttggcgagccgctcggcctccttcttcttcttcgccgcttcctccgccgccttcttcttcgcggcggcctcggcctcggccgcgtcctgct

SEQ ID NO: 4470 - DNA, 957 bp, Unknown
  Kingdom: Bacteria, Phylum: Actinobacteria, Class: Actinobacteria, Order: Streptomycetales, Family: Streptomycetaceae, Genus: Streptomyces
cgagccgggcccggagatcgtgaagccggagaagccggcccggaccatccgcgcgagggccttctcgttgcgggcgtcgggctcgacgacgacccgcagacgggccgggtcgcggaagacgaagccgatgaacgcggtgaggagggcgtccgtgtaccccttcaccgctcccgcgcccccggcgggcgcgatcagcaggtggacgccgaagtcgccgggctgcacgtcgtagcactcgcctaccggatcggcgtccggctcgtacgtctggaagagcgcggccggaaccccgtcgcgcagggcgaggtaggcgtggtgcgtgggcagcgagccgacgaactcgtagatctcccgcacctgttcgcgggtgtggtcgcccatgccccagaaccgggcccgctcctcggtgacccagccgtgcagcaggtccgcgtcggccgcggggtcgacggggaccaggcgcaccgtcccgaagccgtcgaccttctgttcgtggacggctgcgcggagggcgggctcggcgggctcggcgatggcggcctcggctgcggtcatggcggggttctcctccgggtgacgggtcgtcgggtgcagcaggtcccagtccgtgacgaccgggatgagcgcgccccgcgcccacaggggtgtctggtcgcggtgatgggtggatccgggaactccggacgcgccgaacgggaccacccaccggctgtcctggcggcgtgccaggtcccagacgtagcgggcggccgggccccgggcgaaccggtcggtgacgccggggacgccggaggtggacagcacacagtcgtggtcgcccgcgatccccggccgggcctccgcgtcgggcgtgaggtccggcagggcctgccagggggacagccggtgcagctcgccccacgggccgggcggcgtctcctcggccgccgcggcgacggcctcggccgaggccgcgac

SEQ ID NO: 4471 - DNA, 611 bp, Unknown
  Kingdom: Bacteria, Phylum: Actinobacteria, Class: Actinobacteria, Order: Streptomycetales, Family: Streptomycetaceae, Genus: Streptomyces
atcgtccaccgggcggcgcgccggcccgtgcgcagccggttcgcgcccagcagcgcgacgaccacgaacagcaccggcaccaccagcgccgccaggacggcgggccactgccacaggccgccgagcagccccgccgcgcccgccatcagcagcaccgtgcccggggtgcggagcggcgcggcgtactcggtggcggaaccgcgggtgaccgactcctcggagtggtcggcgagccggtgcagcagcgcggtgcccggcaccggctcgacccgtccggccagcgcggtgaagtgctgggccaccgaacgcagcgcgagtccgtcgccgaggagggtgcccgccagttcgcggagtccctcgccgacgcgttcccccgcactgtcggccgacggcacccgcagtccgagagcgccgagccgggcggtggcctccgcggtgggcgccgccgctccgccgccgccctggagagcccgctcgaccagggcgcggaacgcgcccaggtcctcgcgggcctggtgcagatgcgcttccagggcatcgcgccgggcggggtgcagcaggccggggaaggaccgcagcgcgacgaggtcctcgtccgcgcggtccaggga

SEQ ID NO: 4472 - DNA, 1911 bp, Unknown
  Kingdom: Bacteria, Phylum: Actinobacteria, Class: Actinobacteria, Order: Streptomycetales, Family: Streptomycetaceae, Genus: Streptomyces
accccgacggcggcatcgcccgcctccgcgtgcacggcgaggtcgtcccggacccggcctggctcgcggcactcggcaccatcgacctgatctcggtcctcaacggcggtacgtacgaggacgcctccgaccgcttctactcctcgcccacccagatcatcctgccgggcacctcccgcaagatggacgacggctgggagaaccgccgccgccgggtccgcgacaccaacgactgggtccgcttccgcctccccgcccagggcgcggtccgcgcgatcgagatcgacaccgcctacctcaagggcaactccgccggctggatcgccctccagggccgcaacggcgacaccggcgagtggttcgagatcgtcccgcgcacccgcctccagcccgacaccctccaccgcttcgtgctgcgcgcccaggccgtcgtcacccacgtccgcctcgacgccttccccgacggcggcgtggcccggatgcgcctgcacggcaccctcacggagtccggcgcggccgagctgacccgccgctacgaggagtccggcgcgtaacccgtaccccttccgctccacccccgctccgcccggcggacggctgcgctcccgcgcccgtccgccgggcggcttccagtcgtccgggcggctcaggcggcgtacgcggagaagcgcagcgtcttcgccagcacctgccaggttccgaaggcgaacacccggttcaccgcgttgcagaaggccccgcccgtgcagtcggtgggccggtcctgccaggcccggaccgtcagggagtggaagccgaaggtccgcgagaaggcgaagcggatgtgcatgccccggcccaactggtgccccggcagcgtgttgatctggaagaagtcgttcccgatgtactccacctcgaccgggttgccgcccagcaactcgcaccgcgcccccgcccggatccgacccgcacagccgccgccgaccgggaacagccagaagtggtcggtcagctgctcccggacgtcgtccgcgccggtgaacggatgcagcccgaggctgtagccgtacgtgtagaggtcgtagcagcccgccggaccggcccggcagtccggtcgggccgacaccgccaccggggcggcgggacccgtcagcagaccggcgcacagcgccagcgcgaccggcaccgcggcgaagccgggcatcgaccctcccgtggcctgcctccgaggactgcgacgacccttcggaccgtaggccacgggagaccccaccgcgcgcggacggcggccgaacgcgcgagggccgcacgggcggggcacgcggcacgggctaatctgcggacgttcgaacccgataccgcattccccgggggaagtcagatggcagaggccctgctgtgcgatggactggatccggacgatccggacgccatgacgctcgtcgtggtcgtgtcggaggtggcggaccatcacgagcgcgccgcggcccgcctcgcgtcgtacgggtacgagggggaggactgcctctacctggtgcagacggacggctgggccgaacggcggctggacggtgagctgctgaccgtggacatcgtcgcccaccccgccctgctcaggggtctggaggtggaccgggagcggttcaccgcacggtcctcgggtgatccggcggcgttgcggctgctgcgtgtggaggcgcgcgtcgaccccggagcgtacgggcgggcctcggaactgaccctcgtcctgacggcgcccgccgggaccccggccgagcaggccgtggcggcggtccgggccggtgaggactggccgctcgtcctgacgccgcggccggagtagcgggccgtcgggaaccggaggggcgccccctccgccgcggcgaagagggcgccccccggggtcctggccgaaaggtcaggccgtgg

SEQ ID NO: 4473 - DNA, 582 bp, Unknown
  Kingdom: Bacteria, Phylum: Actinobacteria, Class: Actinobacteria, Order: Streptomycetales, Family: Streptomycetaceae, Genus: Streptomyces
tcctgacctcggccgcggtacgccaggtcgacggcctgaccggctccgaggaccccgaggacgcccgggcgctcctcgaactggcccagcgggcagaccgggtgggcggcatccggctcaccgacgccctcacccggctggccgccgacggaaccccgttgatcgccgcggccgccggtgcggtcagggtgctcacgggccacgaagaggcggagtccttcgggaggcgcgtcgcctcctgggtggacggagccgtggacagcacctcccggtccgcgctcaccgcccgcctcaccggcgtcctgacggtggcgggcccgctcctgaccgtcggcatcggcgccctggacccgttgctgctccgggtcgtcgagctggacgacgccgcgttcctggcccggctgccggccctgcgcggtggcttcgacaccctgagtccggccgcccgtgaccggctgctggacaccgtcgaggagcggctcggcgaacgggtggacaccctcgacgcggacgacccggccgagttggcccgccggacgacagccgacctcgccgcccgcgagctcctgaccggcctcggcc

SEQ ID NO: 4474 - DNA, 1213 bp, Unknown
  Kingdom: Bacteria, Phylum: Actinobacteria, Class: Actinobacteria, Order: Streptomycetales, Family: Streptomycetaceae, Genus: Streptomyces
gttccaccccgggacccgggggtggaaccgctcccgggtcccggggtggaacaaccccgtaccgccgggtcggagcaacccattccggaacggtgaaacgggggcaggaagggcccccgagaaggctctcgcacaccgcgccacctgggtgtatgactccgtgtatccactcacttccccggacgggcttggctttggccttacggtcgccttaacctacggtcacgtaacctacgaagccgtaggtaattctcccgtccccaggagctccccgtgacagtcacctctccccacctcggcagctcgaaggcgtggaccgacgcccagctgctgtacgcgctggaagaggtggtggagaaggaactcaaccgccatctcaaggtcgccaaggactggatgccccacgagtacgtccccttctccgacggccggaacttccccggtatcttcgaggacggcgaggcgtgggcggccgaccagtccaaggtcaccgacatcggcaagatcgccctcgtggtgaacctcctcaccgaggacaacctccccagctaccaccacgagatcgcctccctcttcggccgcgacggcgcgtggggcacctgggtgcaccgctggaccgccgaggagggccgccacggcatcgtgatgcgcgactatctgctcacctcgcgcgccgtggacccggacaagctggagcagttccgcatggcgcacatggcggagggcttcgagtcggacaaccggcactcgatgctccactccgtcgcgtacgtcgccttccaggagctggccacccgcgtctcgcaccgcaacaccggccaccagtccggcgacccggtctgcgaccggatgctggcgcggatcgcgaccgacgagaacctccacatggtcttctaccgcaatctcctgggcgccgccttcgagctggccccggacctgaccatgcaggccgtgcgcgacgtcgtcgtcgacttccggatgcccggacacggcatgccgggcttcgagcgggccgccgcgcagatggcgatcggcgagatctacaacatgcgcatccaccacgacgacgtgatccagcccgtgctgcgcttcctgaaggtcatggagatcgacgggctcggcccggagggtgcgaaggcccaggaggagctcggtctgtacatggacggactggacagcgaggcgtcgaagttcgacgagaagctcgccgccc

SEQ ID NO: 4475 - DNA, 638 bp, Unknown
  Kingdom: Bacteria, Phylum: Actinobacteria, Class: Actinobacteria, Order: Streptomycetales, Family: Streptomycetaceae, Genus: Streptomyces
  misc_feature (213)..(214): n is a, c, g, or t
ggcggtggcccgcgacacccccgcacgtgccgcgacggcttccagggtgggccgggacccgggggactgctcgggcaaggcggtcgctcctcgtcgacgggggcggcgatacgcgggccggtacgtggggtgcgcgtggtgctgtgcgcgtgctcggtgtcgccgccggatcgtctacagcctagcgccgggcgccgacagtgctgagagcgnnctgtcggcggatgaggcgaggagggtctggcggctgccggacgaaagtaaccgtcggtagtggtgacgcggttgcccgaactgcgcctcttccgggccaactgcgcgttggacacgctgggtatgcatggccatcactcagagtggaaggtgtgcggcatggaagcgatggagcggcgcagggcggcggcggaccgtgtgcgggtggcggagggcgttgtggagcagctgagggaagggctcgcggagttcggggtgaagctgccgtccctgcggatcgatccggtctcgtgtgcgggtgacgaaccgacgcccctggtcgacctgggccgctgcaacatcgacaccgcgttgcggctgtgcgaggtgctggcggagaaggagagcggtcatgacgggtgacggatgtgagccgggtgtgcccg

SEQ ID NO: 4476 - DNA, 1101 bp, Unknown
  Kingdom: Bacteria, Phylum: Actinobacteria, Class: Actinobacteria, Order: Streptomycetales, Family: Streptomycetaceae, Genus: Streptomyces
gttctgcgtcgacagcagccgctccccccgcggccggggtcacacccgagcaggcggcgacggcggcggagcggctgctgtcgacgcagaacgcggacatgggttccaacgcggtggccttcgacggctccaccaccgtgaacgggcgcgggctgctgctcggcaacccgcactacccgtggcagggcggacgccgcttctggcaggcgcagcagacgattcccggtgagctgaacgtgtcgggcgcgtccctgctgggcgtgacgacgatctcgatcgggcacaacgccgatgtggcgtggagccatacggtcgccacgggtgtcacgctgaatctgcatcagctcaagctcgatccggccgacccgaccgcctatctggtggacgggaagcgggagcggatgacgaagcggacggtgagcgtcccggtgaagggcgcggccgacgtgacccgcacccagtggtggacccgctacgggccggtggtcacctcgatgggcgcggcgctgccgctgccgtggacggcgagcacggcgtacgcgctgaacgacccgaacgcgggaaacatgcggatggcggacacggggctgggcttcggcaaggcccgttccacgggggacgtcgagcgctcgctgcaccggtcgcagggcctgccgtgggtgaacacgatcgcggcggaccgggcggggaactccttcttctcccagtcgcaggtactgccgaggatcacggacgagctggcggagcgctgctcgaccccgctgggccgggcgacctaccccgcttccggtctcgcggtgctggacggttcgcggacggactgcgcgctgggcagcgacccggacgcggtgcagccggggatcttcggcccgggccggatgccggtgctgaagaaccagccgtacgtggagaactccaacgacagcgcgtggctgaccaacgcggagcggccgctgaccgggtacgagcgggtcttcggcacgatcgcgacaccccggtcgatgcggacgcgcggcgcggtcgaggacgtcgcgtcgatggcggaccggggtcggctccgggtcgcggaccttcagcggcagcagttcgccaaccgtgcgc

SEQ ID NO: 4477 - DNA, 1816 bp, Unknown
  Kingdom: Bacteria, Phylum: Actinobacteria, Class: Actinobacteria, Order: Streptomycetales, Family: Streptomycetaceae, Genus: Streptomyces
cctcgaacgcggcctccttcgccgcgaagccgagcagcggcgggagggcggccatggaggcggcggcgagcacggcgacgccggcgacgtacggcagggagcggccgaccccggagagtctgcgcaggtcgcgggtgccggcggcatggtcgacgatgccggtgacgaggaacagcggggccttgaagagggcgtgcccgaggatcatcgcggcggcggcgagcgcggcgttccggttgccggtcccggcgagcagggtgaggaagccgagctggctgacggttccgtaggcgagaatgagcttgaggtcgttcaggcgcagcgcccgccagccgccgagcagcatggtcgcgccgccgaggacgagcacgacgggtttccagacggggacgtcggcgaaggcgggggcgagccgggcgaccaggtagacgccggccttgaccatcgcggcggcgtgcagataggcgctgacgggcgtcggcgcggccatggcgttcggcagccacatggagaacggccagatcgcggacttcgacagggccccgcacagcacgaggacgacggcgacggacacggcgagggtcgtcccgggcggatcggcgacgatcgcggagatccggtaggtgccggcggcctgaccgaggatcaggaagccgacgagcatggcgaggccgccgaacgtggtgacgacgagggcctggagggcggagcggcggctgtgccggtgttcgctgccgtggccgatcagcaggtaggagaagaccgtggtcagttcccagaacacatagagcgtgatcaggtcgtcggcgaggacgagggcgagcatcgcgccggcgaaggcgagcaggttcccggcgaagcggcccagttgcggggtgtcgtcggtgaagtaggaggcgcagtagagcaggacgagcgcgccgaccccggcggcgagcagcaccatcagttcggccggcgcgtccaggcgcaggtcgaggccgacgccgtagtccgggatccactgccaggaccaggtgtccgctcccgaggacgcgacggtgttccagcgggtgaaggcccagccggtggccgccgccgggggcagggccagcacgacgaaggcccgtcggccgagccggtgcaccagcgggcccgcacaggccgccagggcgaagtgggcgacgatgagcgcgatcaccgaggggtgtccggttcgggcggcggggcatccggaataaaaggcactaaatacagatatatccctccggccgattcacccgaccggcgcgccgctcacctcccggcccactgcgttcgaaccctcggggtgcggccgtctcagccgtgtccggcgcaggggccgctgtggtcgcagtacggggtgttgccggtggcgccgcagccgcagagcatcacccgggtctcgtggcgcggaccgtacggggtggcgacttcgaggtccccgcgcaggtgcagcaccccgtcggcgtgcagggagacgtgggtggggacgtccgggacctcgtcgggcatcccgtcggtgcggtggtactggagcgcgccgctcgggcagcggtggatgacgtcggcgacctcgtcggcgggagcgccgtccggctggatccacgggcggcggccgacgtcgaagacgttggggaggccggtcacgcactcggcggcgtgcaggcagcggtgcgcgtcgaagccgacgacgatgccctcgccgtcgtaggagcgggcggcgggacgcgggggtggctggctggtcaccgctgactctcctgatcggctcggcatcctgacctcttcagcctcgccccgccgccgccgcgcc

SEQ ID NO: 4478 - DNA, 618 bp, Unknown
  Kingdom: Bacteria, Phylum: Actinobacteria, Class: Actinobacteria, Order: Streptomycetales, Family: Streptomycetaceae, Genus: Streptomyces
gctgccgcggcagctcgacacgccgctgcgcggctccctcgccaccaccgcctgcatggagaccctccaggtgggctatctgcacgccgtcgcggcggcggcgggatgctccctgtcccagcccttccctgacaacggcatcgactggcacgtcagccacggcgccccggcccacaccgtcgacgacgaagtgaccatcaaggtgcagctcaagtgcacctaccagataccgccgcacccggcgggcggggcgttctccttcacgctcgacaacgcccacctcgtcaagctcgcccgcaccccggtgtcggtgcacaagatcctggtcgtgatgatcgtgccccgcagccaggacgactggctgcgcgccgggcccgggggtctcgacctgcgtcactgctgctactggaccaacctggccggccacgcggtgacgggccggtaccggaccactgtgcgcatcccgacctcgcggatcttcgacgaccgcgcactctgcgacatcatggcccgggtcggggccggagggagaccctgatgcaccggtcgatggacgagcccacgggcggagcgggactgcccgccgcccgctcgcatcccaccgcccgccccgggacc

SEQ ID NO: 4479 - DNA, 2056 bp, Unknown
  Kingdom: Bacteria, Phylum: Actinobacteria, Class: Actinobacteria, Order: Streptomycetales, Family: Streptomycetaceae, Genus: Streptomyces
cccgccggccaaccagccgcccgagccgaacgctcccgagccccagcacttccccgaggagcagctcgcgcagaccggtggaggcgggctcgaactgctcatcccggccagtgccggactgctgctcgccggcgcggggtcggttctctaccgccgctcgcgcagcgccgcctgatcagggcgcgcacagcacggcacagcccggacaggagagcgggccccgcgactgcggggcccgctccatgtcaccaggtggcccgtagctgacggatgatccgtctgcgcagccgcaccctgcggctgccgtccctgcggagcgtcaggcggtccagttcccagtgtccgtactcggcgtggtcggtcaggagtcgggccgcttccttgcgggagaccccgcgcggcacgtacacgtcgacgaattcgtattccggcatcgcatctattgtgcgggcagagccccggtacggatagcgtctgcactatgtctgatgctgcgcagcccaccgctgccgaggtacgtgccgccgccgaggcggtcaaagccgcgatcgaccgtcacctcgacgcggtcgaacgccgtaccggggacgacgaccccgccgtgtacgacgcgttcaacgcccttgccgctgccgccgaggtctacgacgaactcctctacgagcgctacgacgaagtcacccccttcgagatccccggcgcggacgattccctgcctccgtacgccggacccgcggagcccagcgcgctcagcgtgctgatccggcgcgactacgtggtcgcggagcccccgcgcctgctcgcacaggctcagcgcctcgccgacctcgacgcgggtccgggcggcggacaggacacggccccagtggtcggcaccagcgtccatgccgccctcggcgtgctcttcggcgagtacgaaccggacgagatcgcctcccggcacaaggaattcggcctggaggagggcgactccaccctctgggtctcggccggggaagcgccgccggagccgggggagtggctcggcgccccgttcgaggacgccgaccccgaactggtcgtctgccgcttcgacgtcagcgcggtcttcgacgaggaggacgagtcggacgaggacttccccggccccgtggtggacagccgctgaccccttctccttcctcccgcaccggacgtgacggtggggccccggcgcacagcgcaccggggccccaccgctgtccggatcggatcgaccgctcaggacgccgcgtcgggcgtcgggagcgcctccagcagcgggcgcagccgtgtcgtccgctcctgggccggaacctgcgccaccgcgtgcgggagcgcctggtccaccccgtgcaccacggagagatgccgctcgccccggccgaacgcggtgtacacccatggcctgctcagcccctgcgcggcgtcgcccggcagcaccacgaccgcggcgggccagcgcatcccggccgcctgatgggcgctgagggcccagccgtgccgcaccgacgactccacccgctcctgcggtacgacgacgggaacgcctccgcagtccagccgcaggccctcggcgtcggcggagcgcaccaccccgggcaccgcccggccgggcgcgggtacatggaccacgcggtcgcccgggtcgaaaccgccgaaccggccgggtcccgggttcagccgctgcttcagcgcctcgttcagcgccctggtcccggcggccccgccatggcccacggtgatcacctgggtctcctcggcggggatgccgaacgcccggggtaccgagtccgcgaccagctgcacggtgcggtggacggcctcgcccgcgtcgcggaccgggacgatcaccacctccttgcccggggcgtcgacctggttcagctcgccgatgccgataccggagaccagctcgccgatcggtccggggtccggggtccgggagacgacctgcgggcaggcgtgggaggccagcacatcggcgaacacccgtccggcgcccgcggagcccagcacgcccgggtcgccgctcagcaccagccgggcgccggacggg

SEQ ID NO: 4480 - DNA, 1342 bp, Unknown
  Kingdom: Bacteria, Phylum: Actinobacteria, Class: Actinobacteria, Order: Streptomycetales, Family: Streptomycetaceae, Genus: Streptomyces
gttcggccgcctcccccgcgccgcccaggctcacgttgacggtcgtcgcgggggaggcggccgaaccggcgttgcggacggtcccctcgacggtgatgtcgtccgtctcggacggggacgaggggttccaggacagggtgctcacggtcaggtccgggttgggcgcggccgtccccaggacctggacctcggcgatctgcgcgccgggcgccccggtgttggcgaagaacttgagctggagatcggcgacccggccgtccaccgggatggtcaccgtgttctggttgccggccgggttgaacgcgtagccggcgcgggcccggagcgaggtgaacgcggcgccctcctgggttcggccgagtacctggatgtcctgggtccggctgccccagatcgggtcggggttgagcttgaccaccacggactccaggtccgcgtcggcgccgagtttcaccgtgaggtcggccggcagcccgttcgactcccagtaactgttgacgtttccgtcgttggcgttggcggccgggaacccgccgtgcgatccgctggcgacgacgggtttgccccgggccagatcggtggcctcagccgcgctcgcggcgacgggcaggagtccgacggagaccatttcggctatcagcagcccggtgatcgaccgtccggtgagtcgtttccatctcatgatgtcctctgcttccgcgatatttgagcccacaagtcaatcttttgcggtgagaggttcacagatttctgctctgtttctgatttgtcaacggtcttcgcgtggccatgtcattcgggtgtgatcggtgacgatgcgtcagacgcatgctggccggggcctgttcaggccccggaggcacctcgggtcagcagcagcgccagatccaccgccgccacggccaccgctccggccagggcggccttgcgccaccggcggcccagagccgggccggtgagcgccgccgcaccggccagggtgagcgccgccgcacccccggcgtccaccggtcccggcggcccgatcgccagcacggccgtggcgccgaggagcggtgccggcagcagcagccgggttccccggtcgcccagtcggtgcggtaggccccggatcccggcctcccggtccgccgcgatgtccgggagcgtgtcggccagatgtgccgcgaacccgagcagggtcccggccgtcaccgtccaccaccggggccacggcccgccgggcagggaaagggcgacggcggcgggcagggcgccgaatccggccacgtacggcagccaggacagggcggtcgccttgagccgcaggttgtagagccaggcggcggcgacggcggcgagg

SEQ ID NO: 4481 - DNA, 854 bp, Unknown
  Kingdom: Bacteria, Phylum: Actinobacteria, Class: Actinobacteria, Order: Streptomycetales, Family: Streptomycetaceae, Genus: Streptomyces
gtgggtgcccggcgctccggacacccacccccgtacctcctgagccgcgactgctcagaccttcccctcgtcctccggcgtcagcagcgcctcgatccgcgccgtcgccgcgcccaggtggcggcgggcctccgcgagctgggtctccgtcaccccgtgatcgcgggccgcgtcccggatgccgtcgcggaaatggtccagcagacggtccaggtcgcgtaccgggtcccccgtgaccggcgcgtcctcgccccagccgggggcttcctcgggaaccggggcggccggggtgtcgtccggctcgggcctgccgaacgggggccaggcgccggaccgtgcgaagccgccgagctggccggtgatctccgcgaggccttcccgtacgccggagggccagtcaccccgcgcgaagtgctcctgcacctggcgggcggcggcctgcatctgctcgcgcgccttctcctgggcctccttggcctggcggcgggcctgctgtgcgtcctcccgggcgcgccgggactcgtccttcgcccggcgtgcctgctccttccactcctgcttggcccggcgcagctcctccttcgccgcgcgccacgcctcgctgtcgccgaggtcgcccaggctgccgaagtcaccgaacggggaggagggttcgcccttccccctgccgctcccggcctccgtcttcgtactgccgtgccgggactccgacgccgccgcccgcatgtcgctgcggagccggcccgccgcgccccgtacgtcgtcgcgtatctcggcggccagctcggagaccgagtcgcggatctccagctccaggtcggccagttcgccgctgcggcccgccagctcctcgc

SEQ ID NO: 4482 - DNA, 674 bp, Unknown
  Kingdom: Bacteria, Phylum: Actinobacteria, Class: Actinobacteria, Order: Streptomycetales, Family: Streptomycetaceae, Genus: Streptomyces
cccccttccttcgaggagagcacgacatgtccgacccgcacgacgccgacgctgtccgcgcctccctggccgagatcgcctcactgctcgccccggcccaccccgccgtggccgaggaggtgctgcgcgcccacgacagcccgcacgactacgtgagcgccttcggggaccggctggcggagcgggggatcgacgagccggtcgacaacctcgcctggatcgctctcatcgacgcgctcgacgcacacggcctgctcgcggagttcgactggaaggaggacgcgcaggagatccgggcccacctgcggaagctggaatcgaggccctccgtggatccgtgggtgctgttcgaggccgaggagatgctcctgccgaccgacaagttcctgcacgcctgcggccgccgctaccgggagatcggtgcggcgctggccgtcctcgacatcgagtccgactgctatccggtggtgggcctgcgggcggcccgtgccgacgagctgaccgcgctcgccgcccgtgcgggctttcccgtgcagcacctcggcacgggccggcgcaggcggtgacggagccgctgcccgcacccgccggggcggggtggggtgctgttccagcaggtgcggcggggtccgcgcgccggaatggaatcgcgaccgccgccgcccaccacgtac

SEQ ID NO: 4483 - DNA, 1080 bp, Unknown
  Kingdom: Bacteria, Phylum: Actinobacteria, Class: Actinobacteria, Order: Streptomycetales, Family: Streptomycetaceae, Genus: Streptomyces
ccgtagctgccgtccgcgcggccctgcggtccccggaaggccgcgcggacggcagctacggagggctggtcaccggcggcatcgacttcgccgtgggccggctcggcggcgcgttcggcgaccgtctcctcgtcggggcgatcgacttcaacctctccgcgcacggcgccgagagcctgcgcaccttccgggaccgcgcccgggagcaggcgatcgacgagccgtacgcgtccacccgcgtcttcctgccgccggcggaccggacactccatcagatgaccgcgacagcccggtccatggccgcacccggcgccctgctggaggcggtggcctgcgtaccgcgacggtggggcatggtcgccgcgaccggcgccggaccggccgtcgccgccgcccgggccgaggcgctggtcgcggctctggccgcgcccggcccccgcccgtgatcaattcgcaatcgattccgctcttgaccgagacccatcaacagagcgggcgattacgctccgaaccatgcccaacagcccgtcccccacaggcagtgacgccgccgccctcaccgaccgtacggacgaccgtcccgtctatgtcgtcggcggcggccccggaggcctcgccgtcgccgcctcgctgcgcaaccggggtgtacgggccgtggtcctggagaagtcggaccgggtcggcgcgtcctggcgcggccactacgaccggctgcacctgcacacgacccgccgctggtcggcgctgccggggttgcgcatgccgcgcgggttcgggcgctgggtgggccgggacgacatggtgcggtacctggagaagtacaccgagcaccacgggctggaagtggtcaccggcgtcgaggtgacgaggatcgaccgggatcccgacggctccggcgactggcagctcacggcgacgggcgggcgggtcctgcggggccgcgcggtcgtcgtcgccaccggcttcaaccacaccccgcgcatcccggactggccgggccgcgacacgttcacgggcgaactgctgcacgcagcgcagtaccgcgccccggccccgtacgcggaccgggacgtcctggtc

SEQ ID NO: 4484 - DNA, 622 bp, Unknown
  Kingdom: Bacteria, Phylum: Actinobacteria, Class: Actinobacteria, Order: Streptomycetales, Family: Streptomycetaceae, Genus: Streptomyces
ggcgccggctccgcggccgggcggcggccggcagccgggagagggcccggggcctcccctccgagacgcccgaggacctcgcgggggtgcgccaggtccggcacagtgatctgcggtcctaccgggcggcggtacagggccgtacgggctgagcctgctccgtgacacccccggatgacctgctcggtgacaccccgggggagaagggccgcttcagcgccagtcgccggtgatccaggccacgaggcgggggtgggccgtgtacgggtcgcactcggcgatcaccctggtggagacgaaatcgtaggtgacgacctgcccgacatcgcgcgccacccggccgaaaccaccgctgacgtccccgggttccccgatcgtcaccgggacggaggaagcggtcgtggtctcctcttcgcagccgacgtgagggaggggctggccgaggtaccaaccgcagacgaagacggcgtacagggcggcggtggcacccaggcggcgcggagttatccagtgagacacctgccggagtgttccacgaaccgggttccggggacgcggcgcaccggacacgccgaaggcggcggtcccggagtcttccggggccgccgccttcggcgtgtcc

SEQ ID NO: 4485 - DNA, 685 bp, Unknown
  Kingdom: Bacteria, Phylum: Actinobacteria, Class: Actinobacteria, Order: Streptomycetales, Family: Streptomycetaceae, Genus: Streptomyces
gtccaccactggtcctccggcaggaaatcccgaagtgtctgagggggttggtcctgtgccgggtcggcgggccgcacggtgatctgcccgggcgggggcgggggcgccgaaggtgtggcagtggggtttccgtcgtctcggcccgactccaggtgcaggtcggtggccgtctcggcccagggccgggcatcggcggccgacttggaggcggcgggtacgtcggtgctcgtcgtgggggccgtcgatgtggtgacgggcagcggcttgatgtccggcacggtgtccggaggggtcgtgaccccggagggctcgacgtcggcgggcggcgtcgggccggcgggaaccggaggcggcttcacgtccgatgtgctgtccgaactggtggtgaccaccggcggcttgatgtcctggccggtcgcggggccgtcggtggtgatctccggctcgaccccggccgcggccttctccgtggtgtcgggcgtgaccgtcggtgtggggtccgggccggtcccgccggtgacgggggtctgttcgccggataccaccttgatcgtggacgggtcggtgtcgcgctgttcggtctcggcaccgacggggctctccggcatccgctcaccgggtgcgggctccaccgcgccggactcgccggtcggtcccccctccgtgccgggacgcggccccggcg

SEQ ID NO: 4486 - DNA, 761 bp, Unknown
  Kingdom: Bacteria, Phylum: Actinobacteria, Class: Actinobacteria, Order: Streptomycetales, Family: Streptomycetaceae, Genus: Streptomyces
ggcctcggtcgcctcgtccatcgtgcgctgggcgtcggccacgccggtgcggcgggccaggaaagcggacaccgtctcaccctcgcgacgctcgggctcctgcgggaggtggccgacggtggcggtcggcggggagagccgcagctcgccctcctccgggaggtcgagcccggcgagcagccggagcagggaggacttgcccgcgccgttgactccgacgagaccgatcacgtcaccgggagcgacgacgaggtcgagcccggcgaagagcgtgcggtcgccgtgtccggcggcgaggtccttggcgacgagagtggcagtcatcagggtgtcgatcctaatcgccgccgctccatgcccatcgccctgtacccctggccgccggtttccggcttccgttagcgtccgtgcggcgacggctcgtaccgagggacaggagtgaccgtgatggcggatgtgatcgtggtgggcggtggggtcatcggcctgaccaccgccgtgacgctggcggagcggggactgcgggtgcgggtctggtcacgcgatccggccggggcgacgacgtcggcggtggcgggggccctgtggtggccgtaccggatcgagccggccgagcgggtgggcgactggtcgctggcgacgctggccgtgtacgaggagctgtcgggcgccccggaggagaccggcgtgcggcgggtggcgggactgcaccgcggggaacggctcgcggcgtccttcagcccggccgaccagtcgcccag

SEQ ID NO: 4487 - DNA, 641 bp, Unknown
  Kingdom: Bacteria, Phylum: Actinobacteria, Class: Actinobacteria, Order: Streptomycetales, Family: Streptomycetaceae, Genus: Streptomyces
cacccgttcccgtacgccgcacacctcggtcgcggccctgcccggccggtccgccggaacgggccgcttcgcccggaccccgggtccctgtcccgaccccgtacggatcctccacggtccctacgacgaacagtggctgctccccgaccaccggctgatcgacgcggcccgtccggagctgtggcgggtcgccgacgggcggcagctcttcgcggtcgagcacagtgcggcacccggggattccgggccggccctgtccgtgaccgcactgctgcccgacgggcactcccccgccgggcggcccggccggatcaggccgctctaccgcaggcccggcggcacggaacccaacctggctccggacctcccggacctgctgcgcgagcggctcggcggcgcggcggagcgggacgcgttcaccccggaagcggtgctggcctgggtcctggccgccgcccggccctccgccaccggcccccgggtcccgttgccggccgacgcggaggtgtggtcgtcgggggtggcgctcggccgggagctgatgcggctccagttgcgcgggtcccggggcggggagcggccccgtctgccgggcgggcacaggccttatgtgcgggcggcgctcccggtccgccccatgg

SEQ ID NO: 4488 - DNA, 553 bp, Unknown
  Kingdom: Bacteria, Phylum: Actinobacteria, Class: Actinobacteria, Order: Streptomycetales, Family: Streptomycetaceae, Genus: Streptomyces
ggcggaccgcgtcgccgcgcggacgaacctcagcgcggcgaaccggtccgccttcgagcgcccggacgcggcgtacgcggagacggtcgcggcccgggtcgcgggagcggtcgatttggcccaggtgacggcggggacgtaaccgcgctcccgcccgtcgaggtgacgcccggccggtcacggtcgagggcgacgcggtcctgctggaccacctcgtgcgcaacctggtcgccaacgcgccgcgccacaaccactcgggagggacggtacgggtccggggcggaccggagggtctggaggtcgccgacaccgggccggtggtggacccggcgacaggtgctcggcgacaggcgcgcagtggcagccgctcggcggcaggcgctcagtggcggtagaagatccggtcccggtattccgtcatgacccggccgttccactcgtggccgccgtcgacgttgcccgagcgcagcatcggcggctcgacgccgcgggccaccagctgctcgacggcggcggccagcatcgcctgcatgatcgcgctggtcaccacggt

SEQ ID NO: 4489 - DNA, 644 bp, Unknown
  Kingdom: Bacteria, Phylum: Actinobacteria, Class: Actinobacteria, Order: Streptomycetales, Family: Streptomycetaceae, Genus: Streptomyces
gcgcggccggggtacgggggcggatgcggtcggaggcgcggccccgggacttcgggccgacgagctggctgaggcggtgccggacgcgatcggctgcggcacggaacgggacgcggaccattgggcccgtatgccccggtacggccctcgccatgccgggcggcggccgtggccatgcgtccggggcggtcgccacctgccctcacccggcccggtacgggacaatggccgggtgctggagatgacgcgcgaacagttcgaggagctggtgagccaggctctggaccggattccgccggagctgacacggctgatggacaacgtggcggtgttcgtcgaggacgaaccggagccgggcgaccccgacctgctcgggctctacgagggcaccccgctcaccgaccggggtgagtggtacgccggagtgctgccggaccggatcaccatctaccgggggccgacgctgcggatgtgcgagtcgcaggaggacgtcgtcgcggagaccgagatcaccgtggtccacgagatcgcccaccacttcggcatcgacgacgagcggctgcacgccctgggctacgggtgagcgagcaggccccgcgggagctgccggaggccggcccgcccgccgccccgcagggccgggt

SEQ ID NO: 4490 - DNA, 805 bp, Unknown
  Kingdom: Bacteria, Phylum: Actinobacteria, Class: Actinobacteria, Order: Streptomycetales, Family: Streptomycetaceae, Genus: Streptomyces
aggcgcggtccgccccggtggccgtggcgtgccgcccggacgtccgcctgcgggaggtgctggccggggaccgctacctgctctgctcggacggcctgtccgcagtggtggacgaggcggagctgagggcggcggtcatcgcggcggaggccccggaggaggccgtgcgccggctggtcggcctgacccgcgaggcgggtggacccgacaacgtggcgtgtgtcgtcgccgacgttgtcgtcgctgccgaggagcagcagccccggggacggtagccggtacgggcggagggcggcggtcccggggcgatcagggcccgggcgcagagagaacgcagggccgggggccggtgttcaggtaggccgggccgggtgttccgggaggccgggggtgcgggtcagagccgccagtcgggggcgtgttcgggccggtaggcgcaggtggtcccggtcgtcacggaggccttcaggtgggccgccagcgcggggtgcagggtgtccagcttgcgcagggtgtcgcggatccgggcggtgaccgtcttgcgggcccgctcggtctggtcgcccagccggcgggtccggccgccgagcccggccgcggtacggagctggtcgaggagggcctgccgctcccggtcgtatttctcgaccccccggacgtcgtcccgggcggcggctcggtctatctcggcgtccagccgggtcaggtgctccttgtagcggcgcttggcctcctcgtcgagcaccggatcgccgccgaacagcccggcggcgatccagtgctcgacgaggaggccaagcgccgc

SEQ ID NO: 4491 - DNA, 1030 bp, Unknown
  Kingdom: Bacteria, Phylum: Actinobacteria, Class: Actinobacteria, Order: Streptomycetales, Family: Streptomycetaceae, Genus: Streptomyces
gggcggcctgctcggagtcctgctgtgccgtccggtactggacggtgcccacgaagtcgcgcagcatccgggccgggccggcgagggccacctgagcggccgccctggtctgcggtccgccggtctggaggatcttcagggcctccacccggtcgtcctcctcccgggcggtgtactggcccttctccaggaacgccagcagggcggcggtggtgcccgcgtcgatggcgtcactggcggcccgcttgaccccggtgccgccgttcctggacatctccaggaccttgacccggtagtcgtcggcctggacggtgtgctgtcccgtctccaggaacgccacgacgtcggcgtgcgtcccggccagcgcctgttcggcggcggtcttgagcgcggccgagccgttctccttcaggtgctggacccgggcccggtcgtcctgttcgacggcggtggcgtaaccggtgcggatccactcctggacgtcggcgtcggtgccggtcagcgccgcctcggcggcctgctgggaccagggacccccgtcggtcacgatgtggaacgcggcggcccggcccttggccgcgacgaccgcgggctcggcgccctcggctccggcggcggcgagcagttccttggtctcggtggtgcggcggtcggcctcggccaccgcgtccgattccttggccgcggcggcgtcctcgcgcttcttgatctccccggcgacctggacggagttgtcgaggtcgttccgcagccggacggcctccgcctcgcgggcggtctcttccaccgtgcgggccttggcgaccgcgtcggtggccaccttggcggcggcgatcgccgcgttcgcgtgcttggtggactggttggcgtaatccttcgactggcccgcgtacctcacggcctcgtcggccgccttggccgccgcgtccgcgtgggtggccgcgtcgttggcggccgtacgggactcgcgggcggcggcggcagccttgttggccagggattcggcgttgttggccgcgctcgtcgagat

SEQ ID NO: 4492 - DNA, 516 bp, Unknown
  Kingdom: Bacteria, Phylum: Actinobacteria, Class: Actinobacteria, Order: Streptomycetales, Family: Streptomycetaceae, Genus: Streptomyces
ccgctgtcggaggtcccggacaagcacccgaccgacctgccgaactgctcgaagggcaacagctcgatacgggtgccttccctgttcgacgccccgacggggccgaccaggtcgcagactcatcatgaccccgacgcccacgagttgatgagctggtgcacatggaactcccgcagcggcgacgagatcaacgtgtcctggaagcgctacggctcccatcccgaggagggcaccggggccgagcaggcgaaggcgaactacgagaacttcttctacccgggccacggcaggcgtgaggacatcggagtcggcgaggaagcccactgggtcacggacagcgaattgaactgctcgctgtacgtacgggacgtcaacctggtagtgatcatcagcgtctcgggcagcgcctacccgacggggacgtgcgaggaactgaccaccgatctagcgggagacgcgttgagcgcggtgccgtcctgatgaaacctctgagtccctccgaccccggtgcggccg

SEQ ID NO: 4493 - DNA, 559 bp, Unknown
  Kingdom: Bacteria, Phylum: Actinobacteria, Class: Actinobacteria, Order: Streptomycetales, Family: Streptomycetaceae, Genus: Streptomyces
  misc_feature (404)..(418): n is a, c, g, or t
gtccgccgccgccaggcagcggcgcgcgatggcgtcgctgtcgccgaggatgaccgagttgacgcccggccggacgcccgccgccgtcacccagtgcacggcctccgtgggcaccccgaacgcgaacctgcgcggatgcgcgcggtgggcgtggtcgagcaggtggtacggcctgcgggagacggccaccccaccggtctcgtggaacccgccgttgccgtccgggatgcggtacggcgcacactgccccgcgcgcagcagcccgcgcagcagcgggtcggtggtggtgcgcacgtcgggttcgctgagccgcgcctcgatcagcgccgagacccgtatcccggaggcgggttccccggccgacctgaggacgaacccgctctccggctccggttcggcccgcnnnnnnnnnnnnnnnatcgagaggtacgcgttgaggggggtgtaccaggcccggagctcgtcacggtacgaacggccgctgatgccgctgtggtcgaccaccagccggatctcgttccgcaggtcgcgcagcacgtccagggccgccttcagcggg

SEQ ID NO: 4494 - DNA, 1151 bp, Unknown
  Kingdom: Bacteria, Phylum: Actinobacteria, Class: Actinobacteria, Order: Streptomycetales, Family: Streptomycetaceae, Genus: Streptomyces
cgccctcgccgcccggaccggccgcaccgccaccgacgtgtccgccgaatggttccgccgctatctgcaccacgtcgtgcgccccgtcctctggctcgacgcccacggcggagtcgccctcgaagcccaccagcagaacaccctcgtcctcctcgacccggacggctggcccgtcggcggccgctaccgggacaaccaggggtactacttccgcgactcccgccgcgaagagctggaacagcggctccccgggatcggtgcaatcagcgacaccttcgtctccgacccggtcaccgacgagcggttcgcctactacctcggcatcaacaacgtcctcggcctgatcggggcgttcggggcccagcgcctggccgacgagcaggaactcctcaccgtcctgcgccgattcctcatcgagaccgcggaactgggctcgcccctgcccgcgtatctcctggagcacccccaactgcgctgcaaggccaacctgctgacccggctccacggcctcgacgaactggtcggaccggtcgacacccagtccgtgtacgtcaccatcgccaatccgctgcacagctgagcacccgcaccgggcagactccgaccgcacccgttccggagacgccccccgaccgcacccggtccagagaggagagcgccaccgtgtctcccgccgaaccctcagcggaacccgacgccgtaccggccgaccccggctccgccgaccggtccggcagcagcgcggacgggagcgccggtgtcgaggacaccctcgacctggagctcaccgaggaactcctcgccctgatcgccgaggggcgaaacgccgggacggcccgggccggtgccccccgcgagctgctgggtgacccgggggcctggccgcccgcgaccacggcggcgggagagttcgcgctcctccccgtccggccggagcgcgatctcgccgtcgtcagccgctggatgaacgatcccgccgtggcggccttctgggagctcgccggacccgagtccgtcaccgccgaccacctcaggccccagctcgaaggggacggacgcagcattccgtgcctgggcgtgctcgacggcacgcccatgagctactgggagatctaccgcgccgacctcgaccccctggcccgccactaccc

SEQ ID NO: 4495 - DNA, 1105 bp, Unknown
  Kingdom: Bacteria, Phylum: Actinobacteria, Class: Actinobacteria, Order: Streptomycetales, Family: Streptomycetaceae, Genus: Streptomyces
gccgccgccgcgtacagaaccccgcgtctcgcgggcccccggccgctcactgcgggcacacaccggtcgggtcgtaggagctgccgtaggtgcccacggcgttgccgccggtgttgccgctcatggtgttggagcagaccgggccctgcggggtgcgcatgaacttgatgccgccgctcgcgttgccggtgatggtgttgccgtagacggaggtcgcggtgccgtccgtcgcggtgtccccgccgaggcggacgcccgcgccgacgttgtcgtggacggtgttgtagcggaagatgttgccgctgccccgggcgtcgagcccgccggagctggggtcccgctggccgctgcagtcgttgtgctcgacgtagttgttcgtcgcgttctccttcacgtccacgcactcgttgccccgcgtgacgatggtgttgtggtggatgcggttgttccggctgacgtcggccgccgcgtccggagcgccgttggagccctgctgctcgggggcggtgccgaggtagaccccctcgccgttcttcccgcccccgtcgaacacgaagtcggcgaccccgcagtcggtgatggtgttgtcgttcacctcggcacccgtgacgaggtagcgcagccgcaggcactcgtcggccgcgttcttgagggtcatgccggtgacgcgcaggccgccgaccccgttcccgggagtcgtgctcatgacatagatgagtttgagccggtagcccgacacgtccgaggccgacccgtgcagcccgtccacggtgaagccgctgagcgtcgtgctgtcgtgccggacctggatgatccgggcgtcgccagcgcccttcacgacggcgttcgacggtccggtgatggtgaccccggcccgcgcggtcaccacgtcctgccggtaggtgcccgcggccaggttcaccaccgagcccgacggagccagatccaccgccttctggatcgtggccagcggggcgcccgccgacgtaccggcgttggcgtcgctgccggacggcgacacgtagtacgcgctcgccgccggggcggcggccgagggcgtggtcacgacgagcggggagaggccggcgacgagcgcggcggccag

SEQ ID NO: 4496 - DNA, 922 bp, Unknown
  Kingdom: Bacteria, Phylum: Actinobacteria, Class: Actinobacteria, Order: Streptomycetales, Family: Streptomycetaceae, Genus: Streptomyces
cgccacgcgcaccccggtggacgccgtcccgtaccggacccgtcccgtggtcacgccgcaggacaccgtcccgtacgacggtgagccgggccggggtccggccaggaggcggctgctcgcgatcggcggggccgtgctcgtcgcgggaggaggcctcggcggcgcggctctgctccggctcaccgagaaggacggcccgaacggcggccgggggaccgcaccatcggcgaagacccgctgggcccggggacgtctgctgtggacccggaccgtcggcgacctcggccccaccggccgggtgctgcgccacggcggcgcgctgctcatcacggacgcggcctcggtgaccgcgctcgacgcggccaccggtgcggtgcgctggcggcatccggcgcgggacgtcacggccgtccggccgttcggggaccaggtgcacctgctgcagtccgggctgctcttcgcaccggaactcctcgccctcgacgcccgtaccggcaaccggcgctggtcggccctgccggaccggccggtcaacgcccggacgtccaccgtccccgacggccagtcggcgttcttcaccgtcgacggcgggacgacggccctggtctcctacgcctccgacgccaccctgtggacgaagcgctccctgggcgatcggccctggcgcgcctacgggttcgacacccgtacgggagaggctctctggttccacgaggggacgcgggccgcggtgaccggcatcgacgcggcgggcggtcggctggcggtcgggctccgcctccccacccgttccgggacccccgccgaggagccgttgttcgtgctgaggacctccggcgcgaccccgcggccggagccggagatacccggtggcgccgcgtatccgcacgcccaccccggcgcctcgggcacccggtactac

SEQ ID NO: 4497 - DNA, 1201 bp, Unknown
  Kingdom: Bacteria, Phylum: Actinobacteria, Class: Actinobacteria, Order: Streptomycetales, Family: Streptomycetaceae, Genus: Streptomyces
tggccgagccgacctggaagcgcgggcaggcccgggtgcggtcgccgtcccactgctgctcggcgtgccagatcgccacgaagggttcgcgcagcacgccgccggagtacagccagttggccagccggagcggtgccgggagcctctccgggtgaccggtgccgagcgagagcacgtgcagcgggcggccgtcggggtccaggatgccgagcgcgtccgtgtccgggtcgtggcgcagtcgcagccggaaccagtcgtccggccgcagccggtccgggagcaccggcgggtgcgcgttgacgttgagccggtgcaggccggggtcctcgaccagccgcccgtcctgctcggcgtagcgggcgcggagctgctcgcggaagtggggcagggcgcgcccgccgagggcgcggtccggtccgaggaaccttccgtagagcatgccgtggcccgcgtaggcctcgttgaacagcaactgccgctgccacgtctgggtcagcacgccgtagcggaggtcgccggtccggaagcggtcgggcaggcccgcggtcaggtcgagggcctgggaggcactccagctgacggcctcgccggtggcgaccgcccggtcgatgccggcgatcgcggtgtcgacgatcttctcccgcagtgcgtacagccggtccagcgagcggtcggccgggcccagttcgccggggggcgcgttctcggggatgcggtaggcacgccggtaggtctcggcgctcaggtagtccgcgtggtcgctgagcgggacctcggcgccgacgccgaaccgctcgacgaagacggcggacagcaacgcccgtatgtcgtgcatccagtcgaagacggacagcagggccactccggcggcgaggtcgtcgagctgggtccgccagtcggcggtggacacccggacgtcctccagcacggcgtcctcctcgatgaggatctgcgccggccgtcccgcctcgcggctcagcgcgcccagcgtgtcgcgcagtcggcgcagcgtctcgggccgctcgtcggcggagtcgtcggcgagcccgcgcaggccggtgccggtctgctccagcagcctccgggccgtctccgggaccgtcgtgccggcggggtcgagcagatccgggaagtcggccgcgccgtcctccgggcggctgcgggtgcacaggatgccggcgcccaccgcacgcgccagggc

SEQ ID NO: 4498 - DNA, 502 bp, Unknown
  Kingdom: Bacteria, Phylum: Actinobacteria, Class: Actinobacteria, Order: Streptomycetales, Family: Streptomycetaceae, Genus: Streptomyces
gccgccgccggggcgagcgtggcgaccgcccatcggatcgcccggtacttggcggacaggatggcgctgacgtccacggcctggacgagcagccagccgaccgggtcacggccggcctcgttgatgcgggcggtcagcacgtcgtagtcgaacggggccagcaggtccccgaagtaggtgaccccttcccggtcgcggaccgtgccggtacgcggcaggagcgcgcggaccagagcggccaccgcgaccacccacagcacgcccgcgacgaccagcgccaggtcgccggggccccgccagtcgggggagccgtgccgcccgatgaggaaggcgggcagcgcgagcgcccccgagagcagtaccgcggccttggagtcggcccggccgaggtcctcccggacggtgaccaggagccgttccgcgatgcgttcccccgccctgtccggcccgtgctgacccccgtccggcaccggcccggccggggcgggggaagtccgtgtgg

SEQ ID NO: 4499 - DNA, 1068 bp, Unknown
  Kingdom: Bacteria, Phylum: Actinobacteria, Class: Actinobacteria, Order: Streptomycetales, Family: Streptomycetaceae, Genus: Streptomyces
gcgcaaccccgcggcgtacgccctggtgtggtcgccccggtggagcgtgtcgtacagctcgcccggcggcagccagatcggcaggtcgctccagggctcgaccccggcggccaggaggacttccggatcggtccagcgcagctcggcgtcggacccggtgacgcgcacgcaggcctccagcagctcgcccatggtcgtgtggccgggtcggctgacggtgttgtacgcgccgtgcagcccgcccgccgccgcgtccaggatccagtccgccaggtcccgggcgtcgatgtactggagctccgcctccggcctgccgggggcgatcaccgggccgccccgcgcgatccgcgacagccaccagggcagtcggccgatgttctccccggggccgatgatcaaccctgccctcgccagcagggcccggtcgccgaaggcgtcgagggcggccagctcaccgccgcgcttggcccggtcgtacggcacgtccccgccgtcgtcgggcgacgctccggccaccagcgggccgttctcgtcgagtcccggggcggccgggtgggcgtacaccgagcggctggagacgtaactgaagtgcccggcccggccggacaacagacgggcggcgtcccggacggcggcgggtgcgccgctccaggtgtcgacgaccaggtcccagtcctgcccgctcgccgccagggccgcgagtccgtgcgcgccggcggtccggtccccggtcagcgcgctcgcgccgggcgggggcgcatgtcggccccggtggaacaccgtgacgtcccagccccggtccagcgcggcgtcggtgacggcccgtccgacgaactccgtaccgcccagcatcagaagcctcatggaacgactctgcccaccggaaggcggcgggggaacacgtccacgctgtcagcagaacggggaacctgtcggtgccgggccggccgggcctccccggcgcgagcggaacggcggagggtcagggcgtgcgggccagcggggagcggtggcgcagcagccactcgtggtagccgctcgcccgtcgcgccgcgtcccggtaggcgt

SEQ ID NO: 4500 - DNA, 796 bp, Unknown
  Kingdom: Bacteria, Phylum: Actinobacteria, Class: Actinobacteria, Order: Streptomycetales, Family: Streptomycetaceae, Genus: Streptomyces
gtactgggcgggctgcggcaccacgacctgggtgccgaacaccgccggagccagggcctgtacggcgggcagctcggcggcggcgccgagcagaaagacgcgccgtacctccaccccccgcccacgcagtacgtcgagggcgtcggccagcgagcacagcatcccctcgaacgcggcccgcgccagatgctccggcttcatcgactcgcgccgcagcccgctcagggtgcccgcggtgtgcgggagctgcggggtgcgctcgccctccagatacggcagcagcaccagcccggaggcccccggcgtcgacttcagcgccagcgccgacagctcttccagaccctccacgcccagcatctcggcggtcccgcgcagcgcacgcacggcattggagaggtgcaccaccggcagatgcatcccggtggcgtcggcgaacgaggtgatcatcccgtgcgggtcggcgagcgcctcgtggtgcaccgccatcacggaccccgaggcccccagcgacaccaccgcgtcgcccaccgcgaccccgagcccgaaggccgcggccatggtctcgccggtgcccgcggagatcagcagcccttcgggcgtcatcccggcggagtcggcggggccgagcacctcgggcagcccggcggagtggccgagggccagctcgaccagatcgggccggtaggaagcggacccggccgaccagtagccggtgcccgaggccgcgccccggtccgtcgtccgccgggagggccggcccagcagctgccacacgagccagtcgtgcggctggagc

SEQ ID NO: 4501 - DNA, 1267 bp, Unknown
  Kingdom: Bacteria, Phylum: Actinobacteria, Class: Actinobacteria, Order: Streptomycetales, Family: Streptomycetaceae, Genus: Streptomyces
ggcgaccgtggcgatccacccgaccggccagcgcgcgatcccggccagcagttcggccacgggcggggcgaccggggcgacggcgagggccgcgaacccgagcaccgtcgccggtgccaccgcgaactccgccagcagattgcacgggaccgccaccaggctgaccctcgacgccaggaccaccacgacgggtgcgcacacggcctgcgcggccgccgccgctgccagcacctcggcaagcctgcccggcacccgccgcgcccgcagggcgacgctccagcgtggcgcgagggtcagcagcgcactggtggccagcaccgacagcaggaacccgtagctccgggcgagccagggatcgtagaggaccagcaggacgacagccgccgccagcgcgggaatcagggacctccggcggcccgttccgatcgcgaggagcgtgacgagaccgcaggctgccgcgcggagcacgctcggttccggacggcacacgacgatgaaggcgagcgtcagcccaccgccgatgagcgcggtcccccgcaacgaaagtcccaacaggggtgccagaccgcgccgttcggcgctcagtgccgatcccggcggaccgacgaggagaaagagcagaatcgagagattggctccggacacgctcagaaggtgtgtcagatcagtcgcccggaaagcgtcgtggagttcggacgggaccctggaagtgtccccgaccaccagtcccggcagcagcgcacgcgcatccgcgtccagatcgtcggtcgcctcccgcaacccggcgcgcagttccccggccgcgcgctggatccacgtcggcggcccggtgatccggggcaccccctcgtcgtccacccgcaggaccgcggccaggcgttcaccttcgtgcgcgggaggcgagagccggccgccgagccggagccgggtggacggcagcagcttctgccagtccgccctgtggtcgcccgccgcgaccatgagcagcaccggtgtccggacccgggtgcccgtgccgttcggcgtccgcacctccgtgacctctgcgtcgatcaggagcagggccggggtgctgtgactcccccgtaccgccgggcgggtcgtccggggatccgaggtcacccgcacgtcggcgtcgatccgcgcgtactcccctgccagcgcggggacgggcccgcgccgcacatcggccccgtggagtccggccacggccgcgcccgccgccgcgcacaggaggacggcgcccccggcggcgacggcccgggac

SEQ ID NO: 4502 - DNA, 760 bp, Unknown
  Kingdom: Bacteria, Phylum: Actinobacteria, Class: Actinobacteria, Order: Streptomycetales, Family: Streptomycetaceae, Genus: Streptomyces
gtgctcggctctccggtgggcttgcctgtcgtcggcggggtcaccccgccggtgacacccccggtgaccccgccgacgacaggcaagcccaccggagagccgagcaccgaaccggacccgtccgcctccgagtccgccgcgcccgtcagcggcccggtcgtcgacggcaccctgaactggggcgtcaaggagaagttccgctcctacgtcaccggcccgatcgcgcacggcaaggtcgagacgagcggcggcgcgaccgccgttgccaacggctaccgcttcagcaaggccaccggtgaactcgacgccgaaaagaacacgctgaatgccgcgttccagggcaaggtgcgtttcctcggccacgagacggccggcgcgtacgagctcgatctctccctcagcaacctgaaggtcgacgtcaagggcacctccggcaagctcctcgcggacgtctccaccaagccgcgcgcgaccaccaccgacctgaagcccaaggccgaggtactcaccggcgtgcccttcgccgacctgaaggtgcccgcgggcgcgctcgccgccaagggcggcatcgtaaacctcaagagcatcccggcgacgctcaccgaggacggttccaaggcgttcagcggcatgtacccgaagggcgagcagctcgacgccctgaacgtcgcggtctccctcgacaaggacgcccggcttccgggcggttcgaccggcggctccggctccaccaccggcggttcgggctccaccggcggct

SEQ ID NO: 4503 - DNA, 770 bp, Unknown
  Kingdom: Bacteria, Phylum: Actinobacteria, Class: Actinobacteria, Order: Streptomycetales, Family: Streptomycetaceae, Genus: Streptomyces
cccacggccggtgcgcgggagggtggcggcggcacaggcccgccgaactcggacccgtcgaacccggaccccccgaactcgggcccgtcgaacccggacccgtcgtctcttcgccccgctgccccgtaccgatcgtcggactccataacggtccccccgccgtcgagcctcaaaagtcctcgacaatctgcccggatccgtcctgttccactccccagtcggtgggcgatttcccgtcggttcgtccgtgatcgatccgaggcacagtctgggcggaaatgcacgtgacgaggccgccggacattcggcattcactcgaacgaaaatacagttcgacaaggggtcactgtgaccgcaaggatcatgtccgtcagctccccggagcccggcgatccgttcctgtgcggaaccgtccgagtgcccaactcggcttgagaagaaagcagttatcgacccatgtactacaagctcctgcagtggatgtggggcgctcccagcgcctgatctgccctcgtcggcggcgcgtgacagctgccttcgatcgaacggaccggcacccgggcaagcctcaggagccggtccgcttcgtctcctcccccagcagccgccgcaggctctccgcctcggcctcggagcccaggctccggtacacctcctccgccctcctcgcgtactcccgtgcctggtcgctccggtgcatgcgcagcgccgtacgcgcgaggcccgccagcgcccgcgccgcggcggggcgggagccggtccgctcggcc

SEQ ID NO: 4504 - DNA, 779 bp, Unknown
  Kingdom: Bacteria, Phylum: Actinobacteria, Class: Actinobacteria, Order: Streptomycetales, Family: Streptomycetaceae, Genus: Streptomyces
cgtacgggccagggccgccatcggggccaccctggtcgtcgccgtcgccccgatggcggccctggcccgtacggacctcacttcgcctccagccggtagcccgcgccgcgcacggtgcggatggcggtcgcgccgagcttgcggcgcagggtggagacgtagacctcgacgatgttcggatcgccgtcgtaggcgaagtcccagacgtgctccaggatctccgccttgctgaccacctggcccgcgcgcagggcgagttgctccagcaccgcgaactccttggcggtgagcgcgatctcgtcctcgccgcggatcacccggcgggcggcggtctcgatgcgcaaggacccgacggtcaggacgggtgcggcggtgccggctcccctgcggcgcagcagggcgcggacccgggcgacgaggacgacgtagctgaagggcttggtcagatagtcgtcggcgccggtgtccaggccctcggcctcgtcgtactcgccgtccttggcggtcagcatgaggatcggcacctcgtgtccggcggcgcgcaggttcgagcagacgcggtagccgttcatgccgggcagcatgatgtcgaggatcaccaggtcgtaagcgccctcactcgcccggtgcagcccttcgagaccgtcgtgcacgacgtccaccgcgaaaccctcggcggtcagtcccctggccagggacaccgcgagtcgcttctcgtcctccacgatcaacaggcgcatgcgcacagcctcgcaaactccacctgaaggcgccttcag

SEQ ID NO: 4505 - DNA, 542 bp, Unknown
  Kingdom: Bacteria, Phylum: Actinobacteria, Class: Actinobacteria, Order: Streptomycetales, Family: Streptomycetaceae, Genus: Streptomyces
gacgatgccggggccggaggcggagggtgtggggtccggttcgccctcgccggccgggacgaggagacctgagcagccggtcagcgcggtcagcgtcgccgccgacagcgcgacagcgacccgtctccgcacccgtacgcacacaccgctgcccatgcccccacccctcgccacgacctgtcgtcgcggcctgccgtccgtgcgttcgatcatgtcagaagcggtgccggcgcaaccgccgctcccgcggactcttcagcatcccttgccggtcaccccaagaagatctaagtggacccgcacggttccgggagccgacacttcggacatgaccgccaccgcaccgcaccccttcggccgcacactctgcgccatgatcacgcccttcaccgccaccggagccctggacccggacgccgcccgcgcgcacgccgcgcacctggtggcggagggctgcgacgggatcgtcctcagcggcaccacgggcgagtcccccaccacgacggacgccgagaagtccgctctgctgcgggccgtccggg

SEQ ID NO: 4506 - DNA, 632 bp, Unknown
  Kingdom: Bacteria, Phylum: Actinobacteria, Class: Actinobacteria, Order: Streptomycetales, Family: Streptomycetaceae, Genus: Streptomyces
gcgcacctcgcgccggtcggggccggagcggcagcggtgtctccgcccgcactggctgccgctcccaccctcgctcccgatcccgcggaaggcccggtgcgcctgtcgccgccggagctggaggagttgctcatgtcggtggtggcccggctcaccggctacccgaccgcgatgctcaacgtggacatggagcttgaggcggacctgggcgtcgactccatcaagcgcgtcgagatcctgtcggccgtgcgccggcaggtgggggacgtggcagcgggcgacgtcggccggctcggcaagctccgtacgctgcgggagatcgtcgagtcgctcaccgacggggtccggcctcccgatgccccggagacggccggccgggactccgggaccggtccgggggcccgggccatgcccggcccgtcggccgcgcgaagcaccggttccgacgagcctgcgccgccggtgccgctgacgcggctcgttccgtgcgcggtggagtcaccggcgtccggactcgccacggcgggactgctggacgggcccgtcatggtgaccggtgggggcgcgggcgggtgcggactcaccggcctcgtcgcccggaagctggcggaacgcggcgtggaggccaccgc

SEQ ID NO: 4507 - DNA, 2898 bp, Unknown
  Kingdom: Bacteria, Phylum: Actinobacteria, Class: Actinobacteria, Order: Streptomycetales, Family: Streptomycetaceae, Genus: Streptomyces
ggttggttccgccgccgaggaaccgcgcctccgggtcggcggcgaggagggcgaccgccccggtgacgtcgtgggcgcgccgatagccgaactccttcatgcggcggtctccttcgtgtctgctgtcgggtcctcggcgagtgcctcggcggcgcgggtgacagcctggacgatcgagacgtaggctccgcagcggcacaggttgccgctcatccgctcgcggatctcgtcgggcgtcagcggtggcgggcccgcctcggggccgacgtcgccggtgacggcgctcggccagccggccgcgtgttcctcgatgacggcgatggccgagcagatctggccgggtgtgcagtagccgcactggtagccgtcgaggtcgaggaaggcctgctggacggggtgcaggtcgtcgccctcggccacgccttcgatggtggtgatctcgcgtccctcggccgcgaccgcgaggctgaggcaggagacgacgcgccgctggtcgaccaggacggtgcaggcgccgcactgcccctggtcgcagcccttcttggtgccggtgagatcgaggcgctcgcgcagtgcgtcgagcagggtggtgcggtggtcgatgggcaggtggtgcttctcgccgttgacgttcagggtgatcgcactggacgtcgacgaggtcgctggggccatgatcagccttctctggtgtctggtgacgaggatccgggtcgccggccgacgacgggtcgacccggccaccggcgaacgcgaccggcgctaaggtatccctaaccggactgttgtccgctcacgggaaaaaacgtaacggacagctgtccggttaacaaggacgggtttcggccacgaacccgcgaggaggatccgtgtcccagccgaagaaggacgctcccctgcgtctcgacgcgcagcgcaaccgcgagcgcatcctgcgcgtggccatggccgagctgacgctgcgcgcggacgcgccgctgagcacgatcgccaagaaggcgggcgtcgggcagggcacgttctaccgcaacttcccgcaccgggaggccctcgtcctggaggtctaccgctatgagatgcagcaggtcgccgacgccgcgggcgagttgcttcggacgcgcccgccggagcgggccctgcgcgagtggatggaccgcctcgcccgcttcgccttgaccaaggccggtctggcggacgcgatccggctggtcaccagcgcgccgggcggtcccgccaagcccggccccaccccggtcatggaggcggccggagcactgctccgcgcctgcgaggacgccggcgtcgtccggcccggggtgaccccggacgacttcttcctcgccatcgccggtctctggcagatcgacccgcacgaggactgggagccgagggccggccggctcctggatttcgtcatggacggcctgcgcgtaggggcgcccggcaggtgaccggaccacccgccgccgggtgtcggcgggccgtgtgatgatgccccgtgaagcgctcggacctggggagggcccgggcacaacacacgcgacgggagcggtgagttgagcaagggcggggcgtccataccggacgaggagtgggagcgtttcctgaaggaggcggaggccgggggcgcgggtgcgccggaggagccgtcggcgcgggcccggatggtggcacagcgactccgggaagagcccgacggcccgccggacgggtggcggacgtacacaccggcccggcggcgcaggggcaagggctgggccgcgctcggtctggcggccgccgtcgccgtggtggtcgtggccgtcggcccctgggggatcgccgactggttcgacggcgacggtacgagcgccacgcccctcgccgcggagtcggagcgcccgacggggcctcccgcgcaggaggcgacggaccggcctcccaccctggacgagccgttcagggggtcaccggccgcgcggtggagcgacggaacggcgggcatccacctgcccgaggcacgggcgaccggctggatgagcaaggccgaggtcgcgcgagcgctggagaagacccaggactttctcgcggcgtccgctctcgaccccgccgtactgcgcggcgagcggcccgacaaggccatggcgctcatcaacccgcaccagtcggacgtgcgggacttcctcaagaaggcgttccgcgcgcccgatcgcgagaacgacccgctcctgctgttcagccgcttccggtcctccgacgtgcggccggccggggacgtcgtcaagacacgtggccgggtcaccttccgggagggcaagcgcggcgcggtggaggtgtccaccgacatcacgtacgtctatccggtcgtgcgcgccgaagggggagacgacgaggtcgcgcggaccatcgtgcggcgcgaggtggtgatgagctgggacgacccggcgaagatcgtgatcgagcccgggacgttctccctcgtctcttacaaggtggacaccaccaacggcggttgcgacacctacaccggctatctgacccccgcgttcctcgccgagcgcgccgccacccgcccggccggcggcgccgaggtcgacccgtacgaccggagcacgtcgatggaggaacgcatgcggcagggcgacgacgaggactgcggaaccgccacccgttcctgagaggacggtccgcgcacggcttcctgagggggacggtccgcgcacggcgcgggagcgttcacgggccgcgccgcgaaacaggccctgctcgcggtgctgtccccggcggagactggcagggctctccccggcccggtaggaggagggggatcaggtgcgggcggcagccaccccgccggcgagtggctcgtccgcccgccccgctccccggggggcgcgccgacgagacgggggtcctggc

SEQ ID NO: 4508 - DNA, 586 bp, Unknown
  Kingdom: Bacteria, Phylum: Actinobacteria, Class: Actinobacteria, Order: Streptomycetales, Family: Streptomycetaceae, Genus: Streptomyces
actcgtcgccgacggcggcgagccgcacgccgccgtcggcgacgagtgccagcagggcgggaacgaccggcgatgcccccacgtcgagggcgagaacggcgcgagcggtcacctcgtggtcgagggcgctcagcagaagccggcgggcacgctcgtcccgggccgcttcggcggcggcgaggagggtcgcggcgtaggcacggcccacgacggcccgcagcgcctgtttcagcgcggacctcagtcccgggttgtcgtcgcggccgagcgcccgcaggagatgcgggacggcggccggcgcgcccgcgtggagcagggtggccgccgcggtcttcctgatgttcatgttcgggtggtggaggcggacggcgaccgcctcccccgcccagcgggcccgtgccgtgcccagggccagcagggccgcgcgtacggtccggatgtccgggtcggaggtcagcgggacgagtgtcgcggacagggcgcgccggccgccgtcccgcatctcctgcgggcgctcggccgcgacgacaacccgggactgaggtccgcgctgaaacaggcgctgcgggccgtcgtgggccgtgcc

SEQ ID NO: 4509 - DNA, 967 bp, Unknown
  Kingdom: Bacteria, Phylum: Actinobacteria, Class: Actinobacteria, Order: Streptomycetales, Family: Streptomycetaceae, Genus: Streptomyces
gtgtgctgcgttcggcggtcgtcctggccgaccggcaggcgggcgagccggtgctgacccggctgcccgtgctgggcgtggaggcgcgcggcctgtccggcacgctcgatccccgcgtcacggcgggcgacctggaccggctcacgggcagggacgccgtcgcggtcggggcggaccgggcgaagagcctggacgtcggccccggggaccgggtcgcgctgcggctcggcgacggtacgcgggtggaaccccgggtcgtcgcggtgtacgaacacgcgctgggcctgggcgagttcctcttcccgcgcgaggcgctggcgggccatgtctcggccgcgcgggaccaggccgtcctgatccggaccgggaccgagtccggtgcggacccggcggccgcggtgcggaaggcgctggctccgtacggcggtggggtgacggtgcgggccgccacgggcgacgacgtggcgatcgctccgccggtgtcggacggggacaacgccgtgatcgtcatcggcgtcggggtgatcggcggtttcgcgctgctggccgtggtgagcacactggcgctgatcacgatcggccgccggggcgagttccggctgctgcggatggtcggcacggggcgccggcagctgcggcggatgctggtgctggagaccggcctggtcacgttcgccgggttggtgatcggcacggcggtggccgcggtcccgctgaccgcgttcgccgtctcgctggcgggcacggccccgtatctccccccggcgcactacggggtgatcgcgggggcggtggcgctcgccgcggcggcggggacgctgatccccggcgcgtccgggggacgcttcgtcctgggacgccgggcgggctgacggcgggctcagggcccgggtcgggagctggaggacccgggacctgagccggaggacccgggccgggagccggagggacgggcgggcgtcacgga

SEQ ID NO: 4510 - DNA, 631 bp, Unknown
  Kingdom: Bacteria, Phylum: Actinobacteria, Class: Actinobacteria, Order: Streptomycetales, Family: Streptomycetaceae, Genus: Streptomyces
cctcggcgcggctgacccgggtcgaggcgaggctccggtcgatcgagagcgaggggcacatgcctgccgacgacgttgtgatcagagccgttccggcggtccgggtggccgagctgaccggaacggccgcgagctaccagccgcaggacatcgggccggtgatcggcccgctgtacgagcggctcttcccgctcctggagggcgccggcctccggcccaccggtcccgggatcgcgtgttacgaggacgctcccgagggcggcggcgcgatcgtcgtgcacgcgggggtgacggtgtccgccccggtgggcgcggtcggggacacggaggcgcgagtggtggagctgccgccgttcgaggcggccacgatcgtgcaccggggcgcgatggacgacgtcctgtcgacgacccacaccctggcccgctggctggacgcccacggctaccgctccaccggctacacccgcgaggtcagcctggagtgcccgccggaccgcgggagttgggtgacggagctccaggagccggtggcgaaggcctgagccggtacgtacggcagggggcgcaccgccccctgtccggtgcgtacgggcagggggcggcgaccgcgagaggcccgccccctccccgc

SEQ ID NO: 4511 - DNA, 641 bp, Unknown
  Kingdom: Bacteria, Phylum: Actinobacteria, Class: Actinobacteria, Order: Streptomycetales, Family: Streptomycetaceae, Genus: Streptomyces
gacgggcgcgtccatctcgtcgcgtacggctcgggtgtcctcggcccgtatgccaccgcccggctcacgcagcttcagcggcgccagatgctccacggcgggccggaacccggtggcccacaggatcacatcggcctcgacgacccggccgtcgtcccaggccacgccgtccggcgtgatccggtcgaacatcggcagccggtccagcaccccctgctccctggcccgccgcaccgcatcggtcatcggcagcccggtcacgctgaccacgctccgcggcggcagcccctggcgcacccgctcctccaccatcgccacggccgcccgcccccactcctcggtgaacggtccctcacggaagaccggttcgctccgggtcacccagaaggtgtcggccgcgaacccggcgatctccatcagatgctgcgtaccggaggccccgcccccgacgacgatgacgcgctgccccgcgaactcctcgggccccgggtagttcgccgtgtgcaactgccgcccccggaacgtctcctggcccgggtagcgcggccagaacggccggtcccaggtgccggtcgcgttgatcagggccctcggcgcgtacgtcccctcggacgactccaccagcagccgcccgccgctcc

SEQ ID NO: 4512 - DNA, 1655 bp, Unknown
  Kingdom: Bacteria, Phylum: Actinobacteria, Class: Actinobacteria, Order: Streptomycetales, Family: Streptomycetaceae, Genus: Streptomyces
agcgtgcgccgggcgggccgcccagcgcacgctccagccagccggcgtcggactgccagcgcgccaactgctcggcggtcacggtgctcgaaccggtcgcgaagacattgaggagcaccttcgagaccagcgcggcacgccgcacctccgccgcccggtcgcgggacccggccgcatcgtcgtccggggtcatgagaccgtcgaactcggcggccagctccggatggcgctgcacgaccgagtcgagcgacgtcccgggatccagcagtgcggacggcaggccgatgtcctcgaccacccccaggctcgccgactccagcgcgggctgctcctcaccgtcgaagagacgggccaggagccgccagtacagcacctgacggcggttgtcgtacgggtcgggcccggtctgggacgggccggtgggatcgagcggccgcccggtgaggtcctcggtcatttccgcaacagccttccggcgcgctcgcgcagcacggcgacggcgtcgatggcggccttctccgcccggacaccggccttgtcggtggtaccgcccgcccacgccccggcgtgcacggcgacggccttcttccgcacggtcgcctcgaccgcgagcggctggagcaggaactccccggcatcccagcgcagcagcccgacgcaggagtgggaggccgcgacggcttcgggcgtcagcggaccggcggcgggcacccggtcggcgtcgacgaccaggagctgcccggccaggtcgaacacgatccggccctcctcgctccgggcggtgtacccctccagcagcaccggcacggcgatcctgacgggatgcctgtccagcggtgcgacgcgggcggcggtcgcggtggacagcatcacgcgcgccgtggcgaaggcgtcggcgggctcacccgggcgggcacgcccgtcgtcccagagcagatcgccctcggcggtcaccggcatgccgtccagctccatcgatcgcccctcgctcacggcgccgagcaaggacatgcggggacgcagcagctgccacaggccggccccgacgactgtgtcgggcttgggcgcagaaaccccggcgcgcaccagacgggccggccctccgtccgccggctcgaacacggcgtgtacctgggcctgtacggccgtcgcgtgctcctgcacatcgacgccgagcggcaacaggcgaccggtcaccgtggcgacgggacgttccccggcggatccgtgcaccgtcaacagcagggcgcgcgaccacagatcggcccaccggcgcaccggcacgcgctccagggtcgcccccgggcaggacgccgcgagctcggcggcgaacccgtcgagcagcgtcgcccgacgacgcaggcccggatcgggcagcatcgcggagaccacgggtacggcccccgccacgagctcgtggtcgatgccccgccagccgccgcgcgcgaggtcgcacagccagctgcgggccgccgcgaggaggttcgtcccgtcctccggcacggcggacgccgcgccggagccctccgccccgtcctcggcgacgggtcggccgacggcctcgtcgatccgttgcgtcagggcgtcgtgcacggagccgagcagcgcgcagcgggcggctgcgagcgccacgaagtggtcctcaccggcgacac

SEQ ID NO: 4513 - DNA, 597 bp, Unknown
  Kingdom: Bacteria, Phylum: Actinobacteria, Class: Actinobacteria, Order: Streptomycetales, Family: Streptomycetaceae, Genus: Streptomyces
agagctacgagttcgaggacctcggactcctcgtcctcgaactcgtagctctccgagccgcgcgacagctccagcacgccctgcgcgtagccgacccgttcctgacgggcggcctcggcagccgcctgctccgcgctgtcgtcgacgccgagcagctcggcggcctcgtccagaagcggtacgtcggcgggcgtccacgccccggtgacggacgggcgccggatcgcgtcggcgtcctcgtccggtacgtacaccgggtcggccagaaagtcggcgaggaatccctgggggctcagcggcggccacagttcgtcgaccgccgcgtgcacctccttgctcagcgcgacgtcccggccgagctgggccacgtcgtcggggccgaggaagttgggcccgccgtaggggtccgcgccgatccgctcgacgagctgcgcggtgagcgcgtcgatgacccggaagacgaagtgggggcgggcgagattgtgcggcaggcgggtgtccctggccgcctgccgggcctcgtacgcgatctcccagtccaggaccagatccccgccgtcctcgtgcgggatgaccatcgccgccccgggttcgggc

SEQ ID NO: 4514 - DNA, 1044 bp, Unknown
  Kingdom: Bacteria, Phylum: Actinobacteria, Class: Actinobacteria, Order: Streptomycetales, Family: Streptomycetaceae, Genus: Streptomyces
cggcgatcccggccttggcgggcgcgccgagtccctcggaggccgccgctcccccggcggccccaccggcggaaccggacccggtggccgccgcggcggctcccgctccggcggccccggccgcgccgccggccacgatgcccgcggccttgagcgcgtacccggcggcgaaccatccgatgacagcgacgggcagcagcgccggaatcccggcgttcacatggtccagctcgcccgcggccacccggcacttggcgcatgcgtcgaggtgcttgcgcagcccgcgctcggcccgggtccgcagaccgccccgggcgtgggcgccgagccggtcggcgtactgcgcgcagtccccgccggtggtgagcgcccggctgacgtgggcctgcagataggcctgcttgagtccttcgcgggcgcggctggccaggacggcggtggcgttggcggtgaggccgaacaacggggcgatctcgctcggcgactcctcctccaccgtggtgtgccacaggaccgcctgccagcgctcggggaggctccggaacgcctgcatcgccatcgtctgctcggcctcgtgcatcgcgaggacgtcggcgccgaggtcgagggtgtcgtcgtcggagagctcggaggaacgggaggcctgtgcggcgaacaccgcgaagtcgtcgaccagatgctcacgcttcgcgctcttcgtccaggcggcggcgacatggcggacggcggtcatcagataggcccggaccgcttccgtcggtccctttccgccccgtacggcctggagcgtgcgcgcgaagacctcggccgtcaggtcgtcggcggtgtgcgtgtcccggcagcaactgcgggcgtagcgtaggacggcgcccgaatgtcgccggaacagctcctcgtaggcctggtcgtcaccggcgcgcatgtcctcgatcaaccgggcgtcggacagaccgagatcgggggcaccgctgcggcccgcgcgctgctgcggaaccgcgtgggcgccggccgcgccggaggcgtcctcctcggcgacggcgggcc

SEQ ID NO: 4515 - DNA, 839 bp, Unknown
  Kingdom: Bacteria, Phylum: Actinobacteria, Class: Actinobacteria, Order: Streptomycetales, Family: Streptomycetaceae, Genus: Streptomyces
cgccgtcgcggcgggcagcgaggacgcgcggctgctgggggtgcggcgggccagcccgctgctgcggcagcggcacctgacgtacacggctgcgggccgggccatcgagtggacggacgaccgctaccgggcgggcagcgtcgtcttcaacgtgatgaactccgcggcggcggcgccgctggagcgccgggcggggccggacgtggcgggctgagacgctcccccgtacggaacgcgggaggcccccggtgcggaacacacgggagaaggcctctccgtacgggatcagcctccggaggtgtccagctccgcgtcggcgccgacgcccgcgcagtcgtaggggtccttcagccagccgtccggcagcacgacccggttgttgcccgaggtccggccgcgcggtccgtcggcgccgtccggccagggctggtcgaggtccagctcgtgcagctggccgctcagctcctccagcgaggaggtgatcgccagcttcttgcgcatctcggaaccgaccgcgaagcccttgaggtaccaggccacgtgcttacggaagtcgatcacgccacgggcctcgtccccgatccactcccccagcagcgtcgcgtggcgcaccatgacgtccgcgaccacgcgcagggtgggcgcgtgccgggcctcgcgcccctccatggcgttcacgaggtcggcgaagagccagggccgcccgaggcagccgcgtccgacgacgacaccgtcgcagccggtctcccgcatcatccgcagggcgtcgtcggcacaccagatgtcgccgttgccgagcacgggaatctccgggacgtgctccttgagccgggcgatgg

SEQ ID NO: 4516 - DNA, 861 bp, Unknown
  Kingdom: Bacteria, Phylum: Actinobacteria, Class: Actinobacteria, Order: Streptomycetales, Family: Streptomycetaceae, Genus: Streptomyces
gatccggtgcgcgaccggatcgtagaccgcgtacaggcaggtcgccatccggtcgcgcaccggatcaccatcgccaacgccggacacccgccgcccgtgctgctgcacctgggcgggcgggccgaggtgctggtggtgccgccgggcgcccccatcggggtgggcggcgtcgacttcgaggccgtcgagctggacgctccggccggcgccacgctgctcctctacaccgacggtctggtggagtcccggctgcgggacgtgtggacgggcatcgagcagctgcgggagcgtctcgcggcgaccgcgcagctcaccggcccggaccactcgccgccgctggaggccctgtgcgacgacgtgctggacatgctcggcccgggtgaccgggacgacgacatcgcgctgctcgccgcccgcttcgacgggatcgcgccgagcgatgtggcgtactggtacctggagccggaggacgcggctccgggccgggcccggcggctggcccggcgggcgctgagccgctggggtctggacgacctggcggacgaggtggagctgctggtcagcgaggtcgtcaccaatgccgtgcgctatgcggagcggccggtgacgctgcggctgctgcggaccgacatcctgcgctgcgaggtcggcgacgactccccgcagctgccccggcagcgccgggcgcgggagacggacgagggcgggcgcggactgttcctggtcaaccggctggcccggcggtggggtgcgacgcgtctgtcgacgggcaaggtcgtctggttcgagatggcgacccgggggcagtgaggagcccgctgcgggcggcatgacaggagggggcgggcccgcgggcccgcc

SEQ ID NO: 4517 - DNA, 888 bp, Unknown
  Kingdom: Bacteria, Phylum: Actinobacteria, Class: Actinobacteria, Order: Streptomycetales, Family: Streptomycetaceae, Genus: Streptomyces
ttctggagccggcgccgcgtgctcggtgcactcgccgccgccaccgccgtggcctcgacgccctcgatgctcctcactccggtcgccgccgcggcggagagtgcggcggcggacccggtcccgctgccggacaccgagcgggcgaaggtggtcaaagcctggatatcgggcggtagaggcgccagatccgcggccgcccaagccctgctcggctccgacagcgagatccagaccttcctggccgaaacgctgccgaaccagacggcgcaggacaaccgcgtcgccatcgtcagctgcctggaccgcgcgggcaagggcttgcgccgcgaggcggtcgccgccctcgacaacggtgacgccgctatcgccgagttcctgaagaacggcttcaaacccgccattctcgaagacctccgggtggccaccgccatcgtgtcggccaccggcgacagggcggtccagcgggaagccaccgcagccctgaacgccgacacccagccggcgctgaccgcgttcctcaccgatgcccagtacgacgcgcgcctggaggacgcccgggtccaggtgaccaccatgatgatgcaggccggcccggaggtgcagaagtacgccgaccgtgcgctcagcggcaccgcgtccgacgtggagtggttcatcgagaccgggcagcacatcgcccgtgcccgcgaccaggagtcggcgaagatcgaggaactcgtcgccgtcgtcgagcgggagggcaagcgcgccgagcgccagacgaacctggccgtcgaggcctccgagcgcgcccagaccgccgcgctgaaggcgaaggaagcggcggagaaggccgcctccgaggcagccgccgccaaggaggacgtacagaagtccggagcggcggcc

SEQ ID NO: 4518 - DNA, 626 bp, Unknown
  Kingdom: Bacteria, Phylum: Actinobacteria, Class: Actinobacteria, Order: Streptomycetales, Family: Streptomycetaceae, Genus: Streptomyces
caccgcaccagggcgaggcccgcctgaagaccgctcaccacgggcccggccgggaacttcctcgccgggccggagccgcccgcccaccgcgcacgacaccgctggtgatcggcactgtcctggagctcaccgcggtcggccgggcgcccgcacccgcacccgtgcctgtcaggacgccccgtacggtgatcagtgcggcagcgtcgccgggctgccgccgttcgcctcgtagccggcgaccgccagcgcccggtagaccgtgtactgcgcggccgggtccgcgtccgccgtccacggcagcgcgcccacgtggccgtcgatccggatcagctggtgcatcgcctccgaccagcgctccatgtggaccaggaacagcaccagcagatgccggacatgggccagcatcggatcgtccgaccgcgccgcgtgcaccgcgaacatcgcgccctcgaccgccttggtcaccacctggccccggtagaagccctgcacgagattgacctccggcaggtgctcgtacaccgcgaacagcggcagcgccgcgagcagcgaaccctgcggggcgcgggcggcggcggccgtggcgaaggcgtcggcctccgcgcgcgagccgtgccacttctcgc

SEQ ID NO: 4519 - DNA, 1172 bp, Unknown
  Kingdom: Bacteria, Phylum: Actinobacteria, Class: Actinobacteria, Order: Streptomycetales, Family: Streptomycetaceae, Genus: Streptomyces
cagctccgccgcgcgggccacggcctcggcggcgcctgccccgtcggcggcggatccgggtatgcccgcgctcatcgtccgtccgtcccggtggtgcggccggtcagcagggcgaccgtctcggacagctgggtgaccatcgcggcctggacctcggccagttggcgtatctgctcggacagtgcggcgacctcggcccgggtaacgtatacgggcgcgtccgtgaccggcgcgggcgtcggctccacggccaccggcatcggctgcatggccgccgagatcggctgcacggccgccgagatcggcttcccggctgccgcaggcgtcgtcgcgggagccgcccgcccggctatcagcgctgccgtcagccggggtgtgcccgcctcctccaggacctcccgcatgctgatctccgtgccgaactcggcctccagctgccgcaccatcccgatgagctggagcgagtccgcgccgaggccgacgaaggtgcggtcggcggcgacctcgtcgggccggtggccgagatggcgcgcggtcagctccagcaccctgtccagtacggcctgttcggtcatgcggtcctccgagaagcgtggggatggatgggcggccccgccggtcggcgcaggcggccccgtgagcggggtgggcggtaccgggggtgtgtacggcgccggacccctccagtgcgatcggcgctggaaggggtacgtgggcagccggacgcgccggccgccgcagcggtcgagcagcgccgcccagtcgaccccggcccccgcgcagtgcagcgcggccaccgcccgctcccactgccgcgtcggtacgcagaccgcgtccggcagcgaccggcggaccatccccgtcagcacggcggacgggcccagctccagcagcagcggggacccggccagccggtccaggacggcggcgaagtcggccgtgcggcgggcctgcgcgaccaggtacgcggcgtccggccgccatccggcgcggcggaccgtgccgtcgattccgtcgacgaactccgtgtgcaacggccggagttccaccttgtcggccagcacccggaactcctccagcgccgggtcgagcagcgccgtgtggaacgcccggtccaccgccagcggctcgtacgcctcaccccgcgccgcgagcagcgcacgtgccgcgtc

SEQ ID NO: 4520 - DNA, 694 bp, Unknown
  Kingdom: Bacteria, Phylum: Actinobacteria, Class: Actinobacteria, Order: Streptomycetales, Family: Streptomycetaceae, Genus: Streptomyces
gtcgacggcccggtgcgcgccccggggcccggggtggcggcacgcgcagccggaacgtgtcctcgtcgcggtcaggatcccggtacacgggcggcagggtccccgtgggacggcggcgcgtcacgaggcggctccgctccgcggcaccgggttctcgtcggcgtacgcgatcagctcccggaaccgcaggctctgggcgacccggaccaggtccccggcggtgacgggagcgccgcccgccgcggagggcgcgggtgagacggacagggccaccgagctgcggcccgaccggtactggagggagacctccgtgcccgtccggccctcggcgggctgccggtacacccgggcgggcgtgccgtcgtccagggtgaggtcctcgcaggtcagctccttctccgggaggtcgcggcaggcgggcgccgcgccttccggctccgggcgcaccgacaggcggacggagtgcacgacggagccgcgccgcccctggtagctctccgggccgtcgccggccggcaggaccgtcccgatcgaggcgggcagcagggcgtccagtgccccggccgcctgctgccggaagtcctccagccgctgggcctcctcggggccgaggccgggcgggaccgacgcggagggcgtcggtgcgggaggcatcgggggaacggccgcggagtccgtcggcacgggggtggac

SEQ ID NO: 4521 - DNA, 715 bp, Unknown
  Kingdom: Bacteria, Phylum: Actinobacteria, Class: Actinobacteria, Order: Streptomycetales, Family: Streptomycetaceae, Genus: Streptomyces
accagctcgtcgaccagccccagttcgcgcgcctcggcggcctcgacccggcgggcgctgaacaccagctcggcggcgcgcgccgcccccacgcggcgcggcagcagttgcgtaccgccgccgcccgggatgacgcccacggacacctcgggcagcccgaccacggcggtggcgtcggcgacgatcacatcgcaggcgagggcgagttcgaagccgccgccgagggcgaagccgtgcacggcggcgatcaccggcatcggcagttccaggacgccggtgtaggcggcgcgggcggtgggtcgctgacgtacgaggtcggcgtcggagaaggagttgcgttccttgaggtccgcgcccacacagaaggcccgatcgtggctggaggtcaggacggtggcccggacgtcccggtcggcgccgagcgcgtcgcaggcggcggcgatggagcgggccatgtcggtggagacggcgttcatggccttgggccggtcgagaaccagctcggcgacgtggtcctgcccctcgtgccgtcgtacgacgacgaactccccgtaccgctgctcggacgtgacggtcatggctgcacccctgtcatggacggcctgttaacgagcgttaccgtcacggatcctagacaggacggcaccgcccccgacagggcgggacgggggcggggacgtgacgaccgggacggaggcgtgacgacggaggggcg

SEQ ID NO: 4522 - DNA, 497 bp, Unknown
  Kingdom: Bacteria, Phylum: Actinobacteria, Class: Actinobacteria, Order: Streptomycetales, Family: Streptomycetaceae, Genus: Streptomyces
ggcgtcgggctcgccgccgccggcccagcgctcgtgcaggaattcggtgatctccgggaactcgtggaccgggtaggcctcctcctcggggaactcctcctccccctcggcccgttgccccgcgttcaccagcacccggagcctgccccggtcccgctcccacacggagagcgcggcgaaactgccgctcagcgcctcgcaggcgcccagcgccgccgctcgccacgattcgcgcggcgtgtaggccgcggccatggtctgcgccagcgaaaccacggcccgcagccgcgcatcgtcaccacccatttctacagcctatgtagatttgtccccttttgatcagtttgatgcgtaactaatttcaactatttttgcgcgagataccgccagatattcacgctgtgtcatcaggcctcattcgccgggccagtcgggacgccgcttctcgttgaacgcggcctggcggtcggtggccttctccggggaccgggcggagg

SEQ ID NO: 4523 - DNA, 504 bp, Unknown
  Kingdom: Bacteria, Phylum: Actinobacteria, Class: Actinobacteria, Order: Streptomycetales, Family: Streptomycetaceae, Genus: Streptomyces
tccagccgtccgtcgatcaccaacgaggcgatctcggccaccgaccacgaggtgtacgtcgacaccggcaccgacgggtgcgcggcggccatccggtccaccagaccgccgagcagcggaccgtgcgtgccgcccagccggaaccggtccagtgaccccgtggcattggcgaaccgcaccgcttccgcctggagttcactgaccgccggcagcaccacccgggcccgctccagcaccagttcgccgagtggagtggcgcgcgctccggtgtggtcgcggtcgaagagcgcgccgcccagggccttttcgatccgccgcagctgagcgctgagagcaggctgggcaagccccagggtggcggcggccttggtgaggctgcccgtgtcggcaatggcacggaccgttcgcagatggcgcaactcgagctccataagggcaagttatgggcccgggagcaccccggcaatatgtgtgctccgcctaccgttcggtcggtgtatacgg

SEQ ID NO: 4524 - DNA, 785 bp, Unknown
  Kingdom: Bacteria, Phylum: Actinobacteria, Class: Actinobacteria, Order: Streptomycetales, Family: Streptomycetaceae, Genus: Streptomyces
  misc_feature (434)..(435): n is a, c, g, or t
gcgcctccggaggcgccagagtcgctgccacggctccggcgacggcactcgccgacaacacggccacgagcggggctgtcgcggccctcggggttctcctcggccggtgctgactggctggtgcgggtttcggcatggatgcggtccctcagttctaccgggcagaaggtgtgcggccgctccgagaaggtgcagatcaccttggtgcatcggaggaaagcggaagcagcctttcctgtcaggggttgaccacatcgtaaacatgcttgtgcggcggatgatccagtcggcggcatagtccgtaggcagagtgattttgtcgagaagtgtccagcggtctttgggtgttgtggtattcgcgaggcggtgcttgcgatggcgggcgcaggggtggacctgtacaccgcaggacggatcagttgggtgcggtgcgnnccgctcgctcggaccggccgcatcggtacatccgggatgacaccggtacgtgctcaatgacaccagtaaacgggccggcacggtccttgacgacggcgccggtgacgaacgcggtccggacggcacgggcaggcaccggggcggggtcccggaggtgctcgtcgaacacgtcaacaggcgttgtctgtacgtgagttcgacggcgagtcgtgggatattggtggccactgttctgagacgggggtcctccatgaagagtgcgcggcgaacgccgttccgggtgtggttggtagggcttctggtgccggtgctgctggcggtcgccggctgcggtgcgtcggggcgcagag

SEQ ID NO: 4525 - DNA, 1005 bp, Unknown
  Kingdom: Bacteria, Phylum: Actinobacteria, Class: Actinobacteria, Order: Streptomycetales, Family: Streptomycetaceae, Genus: Streptomyces
gacgctgtccgtcctggccgacgtcgagtcgaagggcggggcgacggtataccgcttcacgcccggttcggtgcgccgcgccctggacgccgggcaggcggcggccgacctgcacgcgttcctggccgcgcacagccgtacgccggtgccgcagccgctgagctatctgatcgacgtcggccaggacggacagcgtctccgccagcgggcgttccagcggacccggcgccacggccgtcaggtcggcctggagcaggacgtggtccaggggttcggggatgagcggcgcgaggcgggccgccgccgcgtccgggccctcgtccagcagtgcgcgggcctgtgaggagagcgcgccccggccggtgatgcccagcagctccgcctcgttgagcgtccacagggcgaggcgggagcggaggtccgccccctcgcccggacccgtggcggccggaggggtcgctccgccgcgcaacggacgttcccagcgcagccgtcgcagcagtgtctcggcgtccggagcggtgcccggcgggagttcggcgaagagggcgaggacccggcggcgtacgtcgggggcggccgagcggtcaagctcagggccgagtgcggacagcgcccggcccttggcgtcctgaccgccgaccagacccggggtccgggtggcggcgagccaggcggtggcgaggtgcgtccagcggtcctcggcggacaggtcgagccactcgtccgacgccggcgtcggagcgtaccgttcgtcgggctccccatcggtggccaacaggcctgcgccgtaggccagttcgatccagaacgcggcgatcggctcggtcacgtcgagggagttcgcggcgcgtttcagctcccgtacgctcagtccgcccgcgcgcaggatggcggggccgccgccgttccagagcttcagcagctcctcgacggtggacagtgccgtgaacgcctgtccggccgccgctctgtccacagtctgtggatcgcgttcggcggccg

SEQ ID NO: 4526 - DNA, 1779 bp, Unknown
  Kingdom: Bacteria, Phylum: Actinobacteria, Class: Actinobacteria, Order: Streptomycetales, Family: Streptomycetaceae, Genus: Streptomyces
ccgtgctcatgaagcggtgcagggtccgcgagccgaaggccgtccgctgggcgctgcggcggcgttcggcgtcgtaggcgcgcagggccccggcgatgcccgcggggcgcgggggtgcggcggcgagtgcgcgggtcagggcgtccgcgtccaggatcgcggtgcaggcgccctggccgaggttgggcgtcatggcgtgggccgcgtcgccgaccagggcgacggggaccggcccggcgccggtggagacacgggaggcgggccgggagccggtggagacgaaggagggcagcgccgggtggaggtgcctcatctcgtagcggatccaggtggccgggtcggtggcgtccaggatgcgcgggatcgggtcgtgccagccggcgaaggaggtgcgcagttcctcggcggtggtggcctcgggcacggtggcgtaccagttggtgcggcccggctcgaccggggtcagcccgaagaaccggccgctgccccaggtctcgccgtgcaccgggctctcgaagtcggcgatgccgatccaggcgacggtgccgatccggcgcgggccgctgcggtcgccgaagcgggcggtgcgcacggcgctgcggatgccgtcggcgccgatcaccaggtcctgtccggcggcgagggcgtccacgtcggtgaccctttcgccgagcttgagcgggacgtcgccgaaggcctcgatgccgtcgagcagggcgtccagcaagtagggccgggagatgaggagttcgggacggcccgccttgcgttcgatgcgttccagcgggaggcgggccatgggcctgccgtccggggtgcggatgtgcgcgtcgcggtagggcacggcatggtcgcgcagcgcgtcgcccacgccgagccggtcgagcgcggactgcgcggtggggtggatgccgaaggccgcgccgtaccgctccagttcggtgcgccgttccagcaccgtgaccgtccagcccgcgcggcggagtccgatcgcggtcgccagaccgccgatgcccgcgccgaccacggtcgccgttcctgtcatgtcgcgctcccgagctcgttcggaccctacagagaaccaccacatctgtggtaccacggctggggtagtatcggcaacagaaggaccggaagaggaatgccgtacgggagcgagggagcgcgcgtgaatccggaccggcgggaccggctgcgggacgcggccgtcgaggtgctggcccgggacggcgggcgcggactgacccaccgggccgtggaccgggccgccgaggtgccgccgggcacggccaagaactacttcccgaccagggacgcggtgctccgcgcggtggcggagcgctgcctggagcagtacctcgcgctcaccgggcagctggccgcgacccagggtccgacggaccgcgagggcctgacggtcctcttccgctcacttctggagaacgtcgcggggccgggccgctcccggctgctggcggtgctggagctccaggccgaggcgacccggcgaccctggctgtccggcatcctcgatccgatggcgagcggggacttcgcgggcttcgagctggcccagcgctccgccggactgcccgtcaccccgcagcgggccgccgtcgtcaccctcgcgctgcacgcggcgatcccgcacctgctgacgaacggtcccggcacgctcgcggcggcggggctggacgacgtggaccgcttcgtgcgcgacctcctggacgcggtgtatccgacggacgcgggcgactgagcgccacggccgggccgccg

SEQ ID NO: 4527 - DNA, 1747 bp, Unknown
  Kingdom: Bacteria, Phylum: Actinobacteria, Class: Actinobacteria, Order: Streptomycetales, Family: Streptomycetaceae, Genus: Streptomyces
gatcgccgacgtcctcggccggacccccgccgcctgcaagcagctcgcggcctccgcccggcgccgggtgcccgacgccggggttccggtcgcggcggacgcgcgggcagacgtggtgcggcgcgtcaaggaggcgtgggagcacaaggacatcgcggccctcgtcgacctcctcgacccgtccgccgtgatgaccgccgacggcggcggcctggccggcgccgccctgagcccggtcgaaggaggcgcgcgcatcgcctcgtacatggtcgccatcgcccaccgggctccggggctcgaactcctggagcggtcggtcaacggcgcgccggggctggtggccctgcgggacggtgtcgtcctgaccgtggcctcgttcgacgtggccgaggggcgcgtcgcccggatctgggtggtccgcaacccggagaagctgcggccgtgggcgacccgccgggtcgacgatcacccctaccggcgcaggtcgagccgcatcaggacgcgggggtgaccggccagcaccgacgcggtgtccgcggcatgggtgaacccggcgcgctcgaagttcttccggatcccggcgtacgccatcgtcaggtcgaccctggcgtcaccgctgtcgagcgggtacgcctcgatcgccggcgctccgtgggcacgggcgaactcgaccgcaccggagatcagggcgtgcgagatccccctaccgcgatgaccggggcggacccggacgcaccacagcgaccagaccggcaggtcgtcgacgtgcgggatgccgcgactgcgggcgaaggcggtgtccgagcgcggcgccacggcggcccagccgaccggatcgtcgccgtcgtaggcgagcactcccggcaggggctccgcacggcacagcccggcgacatactcaccgcgggccggaccgcggagctcgttgttgagcttggacggaatccggtagctcagaccagcagacgttggccccggacgacttcgggccgaccagggtacgaacatcctcgaataccgaagccgggcggactgcgatggtcatggcgccacgatgccacggtgcgaccgacggcacctccgggggtgttgctcacgccgggccggccagcgggggtgcaggcgatccgaggctccgcggcgcaagctgcggaccgggagccagccgtggtcgcggggccgtcgtcccggtgtgcggggtgtggttggatcacgctgtgtcgggccctggggccgaacgagaggccctgcgtcggttggggtgggcggggacgtcgtgggaggcggacacgtgctggaggctgcggggatcggggcggaggaggagcgggtgtaccgcttcctcgtcggggtgcgcgaggctgatgccgcggtgatcgcggatcagctgggaatggaagtggatcaggcgcgccgggagttggcctcgctccacgacaaagggttggtggggccggtggccgcttcggcggcgagtggcgcggtgcgctacgtgccggttgcgcccgatgaggcgctgcgcccgctgctgctgcgtgggcacgaggcgctggagtcggcgcggcggggggtggagcagctcactgaggagtaccgggcaggaggacgacggcatgacgctgtacagctcgtcgaggtgatctcgggatatggcgtacggggcccgtgaactgcggtggttctgcaaggccggccatgtggcgatgccctcggacgacaacgacgaggagtgggagcttctcgcccg

SEQ ID NO: 4528 - DNA, 594 bp, Unknown
  Kingdom: Bacteria, Phylum: Actinobacteria, Class: Actinobacteria, Order: Streptomycetales, Family: Streptomycetaceae, Genus: Streptomyces
  misc_feature (248)..(261): n is a, c, g, or t
ctcggcgggcgcgccccggttgtcgaggtgttcggtctgccggacccggccggtgcccgccaggtccaccacgcacaccgagacgtaatcgatgttgatctccacgccgagcccggccgggccggtccgggccaccttgagcgcggtgcccggacggccggcctgcccgctgaacgtcttgcccgactcggtgaggaacccgctgtccatcagctgctcgacgagcgaggacaccgcggcccgggtcnnnnnnnnnnnnnncctcgtcccgtacggcgcggagtaccaggctcagattgtgccgtcgcacggtgtccttgtcggccttgggccccagcggagtgaggatgctcttcatatcgtcgccgagcctatgtgatccggggctcccgacggaggtgcgggaacgggcggtatcgcggaaccggaaggtacggcatagcggagggggtggtcccggccgtccggccgacaccacccccctggcgatcggactcggctcagggtttggcgccccgggccttcagcatgtccgccatcaggccgatctccgactgctggccgcgcaccatgcccgccgccaggttccggacg

SEQ ID NO: 4529 - DNA, 617 bp, Unknown
  Kingdom: Bacteria, Phylum: Actinobacteria, Class: Actinobacteria, Order: Streptomycetales, Family: Streptomycetaceae, Genus: Streptomyces
gcccggccgcgcggctcccggccgcgtatcggctccaccgcgagccgggtcatcggcggctggctgcgccgactgcgggtcgccctgcccggcaccgacatctcgctgcgggtcgacgtctccgcccacgcactcctgcgctcggtcgaggcggaccgcctggacgtcgccttcgtgcacgaggtggagggctccccgctcgccgtgccggagggcctggagcagcgcgtgctcgtggaccgggagccgcagttcatctcgctctcccgggaccacccggccgcccgccgccgcgtggtggagctcggggacctggcgggcgacccgtggatggtcgatccgacggtggacggtgagtgggacggggtgcgccgggtgctcggcgccgccgggctgaacccgccggtcctgcacggcgactacctcaccgccgcctccctcgtcgtgctcggcgaggccgtcgccccctgccagccgacatcgggcccgcgcgacgacatggtgatccgtccgctgctgggcgatccgctcgcggtacggctgctcctggcctcccggccagggatggacgtcgcggtggtgtacgcggagttggaggacgcctaccgggacgcggc

SEQ ID NO: 4530 - DNA, 1931 bp, Unknown
  Kingdom: Bacteria, Phylum: Actinobacteria, Class: Actinobacteria, Order: Streptomycetales, Family: Streptomycetaceae, Genus: Streptomyces
cggcccggcggcggtccgggccgcccggctgcggacccgaatcggcgcacgaatgtcccggcgcacccatcattgaggcatgcccgaaggagacaccgtcctccagaccgccgcccggctgcacaaggcgctggcggggcaggtgctgacccggtcggacctgcgcgtcccccgtttcgccaccgccgacctctccggccggaccgtcctggacgtcaccgcgcgcggcaagcacctgctgacccgcgtcgaaggcggcctgaccctgcacagccacctccggatggacggcgcctggcgggtgtacgccccggacgaacgctggcggggcggcccgggtcaccagatccgcgcgatcctcgccaacgcggagcacacagcggtcggctaccggctcccggtgctggagctgctgcgcaccagcgaggaggaccgggccgtgggccacctgggccccgatctgctgggcccagactgggaccccggcctggccatggaccgactgctcgccgcgccggaacgccccctcggcgaggcgctcctggaccagcgcaatctggcgggcatcgggaatgtctacaagtgcgagctgtgcttcctcgcccgcgtcaccccctggctccccgtgggcgccctccccgacggcgcgctcccccgggtcgtcgccctggccgagcgcctgctgaacgccaaccgcgaccggtccacccgtacgacgacgatcacctccgaactccgcaccccgccgtccctcgggccgaggacgggaaccgggtcgggatccggagccggggcgggaaccggagctcgggccgagcgcccgcgtgcacgtccgaccccgcaacccgttcgcgtacaggagcgcctgtacgtctacgggcgggcccgtcgcccctgtctgcgctgcggcaccccggtccgtctcgccgaccaggacgaccggcccacctactggtgccccggctgccaatcagggccgaccccatagttgacgacccgtcaggtgcggtcgtacggtcccgtcatgcctctctccgcgtacgacctcacgggccgcgccgcgttcatcaccggcgcggcgagcggcatcgggcgggcgagcgccctgctgctcgcggaggccggagccacggtgcactgcgcggaccgcgacgagacgggactgcgccggacgtacgacctgatagccgacgcgggcggcagcgcccggacccatcccctcgacgtcaccgaccgcgaccaggtccgggcggccgtcggcgcggccggacacctcgacgtcctggtcgcctcggccgggatcatgcacaccagcagcgtgctggagacgacggacgaggacctggaccgagtgctggcggtcaatttcacgggggtgctgtacgcctgccaggaagtggcccgctccatgacggcccgctccgcccccggctcgctgatcacgatggcgtccggcgccgtggactccgcgagcgcgggcctgctctgctacagcgtcgcgaaggccgccgtggtgcagctcaccaagacgctcgccacggagctgggaccccacgccatacgggtgaacgccgtcgcgcccggctggatccgtacacccatgaccgaccggcacgacaccgcggaccggcgccggacggagacgacgatggcccggatctccccgctgggccgggtcggtgaacccgaggacgtcgcacacaccgtgttgcacctggcctcggacgcctcggccttcatgaccggtcagattctccggccgaacggcggcgtcgccatgccctggtagaccgccacctcgacaacgaacccaacaagcccgactggcccagcagacccgagcgcaccagccgcccagcccgccccgacgggctcaccggcaccaccgacgcgacatggaccggcaacaggctcagcccccagccccccgc

SEQ ID NO: 4531 - DNA, 906 bp, Unknown
  Kingdom: Bacteria, Phylum: Actinobacteria, Class: Actinobacteria, Order: Streptomycetales, Family: Streptomycetaceae, Genus: Streptomyces
gccgccgtacgcggcgtaccaacggcggccagaacgcgagcgcggcctcccacacccggtcccggtcctcgccctccagcaggctcgcgcgcaccgggatgtcccggccgcgccagttgacgacggcctcgtccgggcgggccagcagattcgcggtccaggccgggtgacccgtacggccgaagttgctgccgaccaggatccagctgccctccacctcgccctccggcatgcaggccagcggcgtggtcctcggccgacccgtgcgcgcccccggcaccgtgaggacgagccccggcagcatccgtgcgctgagcagcacctttccccgggtgagccggtgtacggcccggtccagggcgggaaccacgtggggggcgatccacccgaaggcgcgggtcgaggagaccttctggaccaggcgagcaccacgggcggaggcacgggagcgggaacgggagtggtccatcagacgcctgccccgtacgcgatgccgacgggccgggacgcggcggtggccccgaagagtccggcccgctgcgccgcgtggtcgcgcagccggtggaccgggccgaagaggagctcgtcgcccgccgcccgcttgagataccggtgcgcctcgtgctcccaggtgaagccgatgccgccgtgcagctggacggcctcaccggtggtgatccgggccgcctccagtgcctgggcgagtgcgaggggcccggcctccgggtcccgggccgcgtggtacgcggcggagcgggccgcctccacccgtacgtacaggtcggcgaggcggtgcttgacggcctggaacgaaccgacggccctgccgaactgttcgcgggccttcacgtactccacggtgcgctccagggcgctcgccgccgtcccgaccgcctcggcggcgag

SEQ ID NO: 4532 - DNA, 744 bp, Unknown
  Kingdom: Bacteria, Phylum: Actinobacteria, Class: Actinobacteria, Order: Streptomycetales, Family: Streptomycetaceae, Genus: Streptomyces
cacggcccggacgccggtgcaggcggggtccagcgaggaccggacggagaggtcgccggtcaccagctcggcgcccagcgcctcgacgtccttcgcgcgcggcgccagcggatcgcgcaccagcgcgcggaccggcagtccggcggccagcagggcccgggcggcggccccgccctggcgtccggtggcgccggtgaccagtacgggggcggtacgtgatgccatgggggtgtctcctcgcaaccggggaacgcgaaacggcggggcccgccgttttcttcccggctacgatatggcggggcccgccacttagcaacatggccacttaccaacatggccactcagcaacatggagagaacgtgaccggtcagcgcgcggacgcccgccgcaactacagccgcatcctcgccgtggcggaggccgaggtcgcccggcacggagccgccgcctccctcgaacaggtcgcccgcacggcaggcgtcggctccgccaccgtgcgccgtcacttccccacccgccaggcgctcctggaagccgtcttccaggagcgcgtccaggccctctgcgggcgcgcggacgagctgagccggacggaggacagccgcgccgccctgctggactggctgcgtggcctcgtgcggtacgccgtctccgcccggggactcgcggacgcactgacctacgagccgccgacggacgcgcccgccggcgacgcgccgcactcctgcggcgcgtcgccggcg

SEQ ID NO: 4533 - DNA, 774 bp, Unknown
  Kingdom: Bacteria, Phylum: Actinobacteria, Class: Actinobacteria, Order: Streptomycetales, Family: Streptomycetaceae, Genus: Streptomyces
cgatccgggccgagggcctggccaaggtcccgaccgccgccctctcccggggcctcgcgggcgtggcctcccgcaccctgatcgtcaacctccccgggtccaccggcggggtgaaggacgggctcgcggtcctcggccggcttctggtgcacgccgtcgaccagctccgcggcggcgaccacccccgaccggggagcccaagctgaacatcgcgacctggccggtgacgctgaccgacggcgagatcgtcctgcgcccgataaagatgcgtgaccagcggatgtggcgcgaggtcaaccggcgcaaccgtgactggctgcgtccctgggaggcgacggtcccgccgcccgctcccggcggtccgacggcgcagcgccccacgtaccggcagatggtccgccatctgcgcgccgaggcgaacgcggggcggatgctgccgttcgccatcgagtacgagggccggctggtcggccagctcacggtcgcggggatcacctggggctcgatgtgctccggtcacatcggttactgggtcgaccggagcgtcgccgggcgcggggtcatgccgacggccgtggcgctcgccgtggaccactgcttccgcgcggtgggcctccaccgcatcgaggtctgcattcgcccggagaacgggcccagccgcagggtcgtggagaaactcggattccgttcggagggcgtgcgcccgcgctatctccacatcgacggcgcctggcgcgaccatctgatcttcgccctcaccgccgaggaagtgcc

SEQ ID NO: 4534 - DNA, 553 bp, Unknown
  Kingdom: Bacteria, Phylum: Actinobacteria, Class: Actinobacteria, Order: Streptomycetales, Family: Streptomycetaceae, Genus: Streptomyces
  misc_feature (147)..(159): n is a, c, g, or t
ggtcgccgccgaacggggtctccaacaggtcgacgaagacgaagtccgcgaaccggggtaccgcgaagtcggcgagctcctgcgccgtacgctgtacgtccagagtgctgccgatactcgctccggcctcgttcaccagcccgagcnnnnnnnnnnnnngtagtccgtgatcgcctcgccggtcgacaggacctgccgcatcaaccgctcgatgggcgtcgccagtgctccgggcagcacctcgctcggccggcgtcccagacgctgctcccggggcacgccgccgaaccgttccagggtgtcgttcagccagagatagcgcaggtcggggtcgagcaccgccatcccgaccggcgaccgggtcaggaagtcgtccagcacggagccgcgcatcgtccagtgcggggtgagcgcccgtccggacacgaggaagccctcccgaccggcgatcaggaacgaggcggtggcgtgtacgtcgacgtccagcgaccggccgttccgggcccgcagggggaccagcccgctccaccccgaaccggcccggcagcgggct

SEQ ID NO: 4535 - DNA, 1691 bp, Unknown
  Kingdom: Bacteria, Phylum: Actinobacteria, Class: Actinobacteria, Order: Streptomycetales, Family: Streptomycetaceae, Genus: Streptomyces
gcggccgtcgcctcgtcgaggacgacgcccagggaccgggtgccgcgccccttggcccacacctcggagtcgacctcgatgaccttgccgttcttcacggccgggatccgtgaccagagcgggttctcggccagcttgtcggacagcttgccgtccggcgcaccgaacgacagggtttccacgaacaggacgtcgacgtcccgggcgaggatctcctccaggctgtagctgccgtcgacgccccggctcttccaggggtagtgggagatcttcgggaacagcccggccgccacatcggactccggggtggccacgccgaagttctcgtcgctgccgtagacgatcagagcggtcctgtcgctcttcgtcttctccgcctgcgccaggcgggtgcggaaggccttctccgccgtctcgccctgctcggtgcggccggtgagcgcggccaggtcccgcaggtagccgacgctgtcctgccaggatccgggctggaccggccagaaggtcgtggcgcccttcagtgcgggggccagtttcccgtgcgtgtcctccaggccgatcaccaggtcgggccggtgggacaggatcgcctcgacctcggggctgaggaagccgccgggcaccaccggtatctccgccgccttcttctcgcccaggaacttcgggtgcgccagcacctgggagttggtggcggcaggggtcatgcccagctcgacgaggatgtcgtcgcagagggcgaccaggcagacgatcttctccggcggcttcgacagggagaccgtgacgcccttggcgtcggtgatccgggtggcggcctcgatgggccgcacatccgtgctcgtacgggcgccggcgctccccggagcggcggccggtcctccggtgccggcctcccctgttccgcagccggccagcaggcctcccagcacggcgatcgcggcccagcggcggactctcagcgcggttcgtggcatcgacggttcctcaacgtttctgtgcggtcccggggatgcggcagagacggcggcgaagccccgggagcgatccccgccacaagccgaaaccttacacatgattatcatttccaataaagtgagcggggtcctcgcccgaaccccaccggcccccgccgcctctacgaccccgccgagcgcaggagttcgccatgccgcagtccccacgcatctcgtcccacgcaccgccgcgcctgctggtctccgaccatgtcgccgggcgggtcagcctgttggacctcccggacggcacggagcgggcggagctgaaccaccgacacctggccgagcacgccggcttcctcgccctgccgggtgatctgaccgcctgcgtggacgaccgggcgggcgagctgctgctcctcgacccctacggtcccggtgccggccgaccgctggtccgacggcggataccggtcgcgattcccgccgaacacctggcggcggacccggcagggcgacacctcgcggtgaccacgggcctcggccggaacgaggcggcctggaccgggctcctgacggccgtcgacctcgacgcaccggacggcgccgtcgccgtacgcgtacggggtcggacgggcgagccgggggtcacggtactcggcgggccgtcccccctcgtggtgctgcgccaccgggagccgggcgaactgtcggtccaccggcaccgcgacctga

SEQ ID NO: 4536 - DNA, 704 bp, Unknown
  Kingdom: Bacteria, Phylum: Actinobacteria, Class: Actinobacteria, Order: Streptomycetales, Family: Streptomycetaceae, Genus: Streptomyces
tgtaggtgacggaggcctcgctgggcccgctggtcccggcccagccggcggcccgccacaggcggccgccggtcagccgccagtcggtgaccgccgccccgtccaggagcacggtggtaacggcggtgaccggcggccccggcagccgcaggcgcatgtccgcctcgccctccaggacgacggtggacgtcgtctgggagatcgggcacccggcggcgtcccgcaccgccgccgaggcgacctcgaggaacgtgccgacgacgaccgtttcggacgggtcgacggtcaggccgcgggcggtgaggtcggccaccgtcgcgaggggttgcagtgccacggtggcctccctctcacttcaccaggtcgatcaggtcgtcccgggtgaacgtcgcggcgtcgtcggcggacatctggccctgcgacaccacgtaggcgacccactcactcttgggcgcgtcctcggcgggcttcccgccgcgccccgtaccgagggctcccgtgtcggcggcgtctgcgggaacgtcgggcagttccatcaggtcgcccttggtcatgtcctcggcgacgtcgggctcgaggccgtggacgttgacggcccacccgacccaggccgctttcacctcgttcttccccggccggggcggaactccgttggtcagggcgctgcccccggcgtcgagcctcgggccgtcccatgcgggcag

SEQ ID NO: 4537 - DNA, 848 bp, Unknown
  Kingdom: Bacteria, Phylum: Actinobacteria, Class: Actinobacteria, Order: Streptomycetales, Family: Streptomycetaceae, Genus: Streptomyces
tcgctgagctgcgcggcccttccgtcgcaccgcacccgctcgacgcccgggcgctggccgccctcgccgccaaccccggctgcaaacggcgggccctgctcgacggcgccggggtggacaagggcgtgctggccaccgcgctcggctctcccgcccccttcgggcagtcccagttcgccttcatgcggggtaacgcgttcgaggcgaaggtcaaggccgacggcggcgccgagctgctgcgcctgctgtacgaacggctcggcggcggtgccgaggctccggccggggacgcggccacacccgatctgagcgccgccggtcccgagggccgggccgcgcgcaccgcgctcgccctgcgggaggccacggcggcgggcggctgggcgctgctggaccacccgatgctggccctggaggtggcgggctcccccgcctatctggagcccgacgcggtcgtggtgcaccccgacggccggtggacggtcgtcgagatcaagtcgttcccgatgatcgacgcgtcggccgacccgtcgaaggtcggcgcggccgcccggcaggccgcggtgtacgtgctggcgctggagcgggtcgctgcggtgaccgagggtgcggaggtcgggcaccaggtgctgctggtctgccccaaggacttctcgaacctgccgaccgcctccgtcgtggacgtacgcaagcagcgcgccgtgacccgccggcagctgacccggctgacgcgcgtcgaggacatcgcggcggggttgccggaggggacgacgttcgatccggcgtgcccgccggcggagctggacgccgccgtggccgcggtgcccccggcgtacgccccggagtgc

SEQ ID NO: 4538 - DNA, 1254 bp, Unknown
  Kingdom: Bacteria, Phylum: Actinobacteria, Class: Actinobacteria, Order: Streptomycetales, Family: Streptomycetaceae, Genus: Streptomyces
cggcgaggacctcggcaccgtcgagcccggggtccgtgaggcgctcgcccggcgcggcgtgctcggcacctcggtgctctggttcgagcgcgactgggacggcgacggacggccgctcgccccggagaagtggcgccgggactgcctggccaccgccaccacccacgatctgccctccaccgccgcccggctgaccggcgaccatgtgacgctgcgccaccgcctcggcctgctcacccgctccctggaggaggagctgaccgaggacgccaccgacaccgccgagtggctggccctcctggcccggctgcggatgctccccgagggcgacggcgacgaggaggccgccgtccgcgccgtccaccgcttcctgctgcgcacccccgcccggatgaccggcgtctggctccccgacaccgtgggcgaccgccgcccgcagaatctccccggcacctgggaccagtaccccaactggcgcctcccgatcgccgatgccgaggggcatccggtcaccctggaggagatcaccgcctcaccccggctgcacgcgctgatggacgtcctgcggccccgaaagcctcatacggcacccccgggcgagcgccgtccctaggcgttcgctacgttggcaccgtggacaagaagaacgctatgcgcgccggcgtcgttgcggccgggacgacgctgatgatgctgctcatgtcgagcccggcgctcgcgctcacgcccgacgacggtgacgaccccgctccgcgcctgagcgcgatcgagaccatcggtctctacgtcgtcgcgcccatcgccctgttcgtggtgatcacgggcctggtcatggtcctggacaagtccaagaagcgggtctgacccgcacacgcacgacatgcgcgaacggtgcgccgccggtggaaccaccgcgcggcgcatccgtgcgtccgggcccggacgggaaggcagtcggcgtcgggccggtaggttgcgcccatgaccgagtgggacgtcaagaagctccggatcctgcgcaccctgcgtgaccggggcaccgtgacggcgaccgccgaggcgctccggatgaccccctcggccgtctcccagcagctcaccaatctggccaagcagctcggggtcgacctcctggaggcccagggccgccgggtccgcctcaccgacgccgcccacctcgtcctgcgccacgccgaggcggtcttcgcccagctggagcgggcggaggccgaactgaccggctatctgcgcggc

SEQ ID NO: 4539 - DNA, 1105 bp, Unknown
  Kingdom: Bacteria, Phylum: Actinobacteria, Class: Actinobacteria, Order: Streptomycetales, Family: Streptomycetaceae, Genus: Streptomyces
ctccgaggagggtgcttcgggcgaagccgcgcgggcggacggcgaggacgccgacgccctcgacgaggaacccgggctgcacgccgacgcgctgctcgcctccgtgcgcgaaccgctctccgcgggactcgccaacgacggccggctgacactgggtgtcagcgcggccgtgcataccgccgaagggctgcgcggcgcgctggaggaggcccggcacgcccgccgggtggccgcggcccgtccggggcgggtctgtgcggccggtcaccacgagctcgcctcgcacgtgctgctgctgccgttcgtccccgacgacgtccggcgcgccttcaccgcccggttgctggacccgctgcgcgactacgaccggcgccaccgggcggagctgatcgagacgctggaggccttcctggactgcgacgggtcctggacccgctgcgcggcccggctgcacctgcacgtcaacacgttgcgctatcgcgtcggacgaatcgagcagttgacggggcgtgatctttcgcgcctggaggacaagctcgacttcttcctcgccctgcgcatgagctgatcttccggccgcgcacgggcccggcggcgacccgtcgcgctccggccgattgtgaaatctttcacctgacattgtccggaacccttggcccggcgtgccaatccgtgctgagatgcgccgtacccaacagcacaatggcgcgctcggggagggcaatgtggcgcataccgccatgtctggttccggaacgacagcagatgacgatccgccgctccagaccgcggtatggcggctgcggtcacgcgcctgctggacggacgcggccgcactgctggagcaccacgcgagcaccgatccggcctccgctctccagcgcacggcgctgctgaccgagcggtgtctctacaccggacagggctggaccgacgccgaggacgccctgcgcacggcggaggccatcgcccgcagcgacgacgagcgcggttcggccgcttccgagcgaggccatctggcgtacgcctcgaccctcctggcggtacgggaccgggccgacgaggcgagcgtggcgctgagccggtcggcggcgctgctggcacc

SEQ ID NO: 4540 - DNA, 859 bp, Unknown
  Kingdom: Bacteria, Phylum: Actinobacteria, Class: Actinobacteria, Order: Streptomycetales, Family: Streptomycetaceae, Genus: Streptomyces
cgtgtccggtgagcagggtgaagagagcggccccgcccgaggccactccggacggcgccgctctcttcaccctgctcaccggacacggctgccgggtgtggctggtcaccggtcccggcgccgtcgcggggctcccggcggaaggccgccccgatcatctgtggggcttcaccgtccagccgctgcgcgacgggaccaaccgtcccctcggccacggggtgaagcgagcgatggacgccgtcctggccacggccgggctgctgctggcggccccggtgatggcggcctgcgccctggccgtacggctctccgacggacccggcgtgatcttccgccaggaacgcgtcggccggcacggacgccccttcgtcctgctgaagttccgtacgctgcggcccgccgacgtccacgagtcggccacccgctggaacgtcgcctccgacggacggatgagcagggtcggccgcgtgctgcgccggacctccctcgacgaactgccgcagctgtggaacgtcctgcgcggcgatatgagcatggtcggtccgcgacccgaacgccctttcttcgtagcgcagttcagccgtgcccatcccggctatcaggcccgccaccggatgcccgtgggcatcacgggtctggcccaggtgaacgggttgcgcggcgacacctcgatcgaggagcgggcccgcttcgacaatcactacatcgagacctggtcgctgtggcaggacgcgtgcgtgctggcgcggaccgcgggttccctgttccggctcggaggcagctgatcatggccgctgtcctgaccccgcccgtgccgtccacggcggccgggtcccgcgccgtcccccgtgccccgtgg

SEQ ID NO: 4541 - DNA, 808 bp, Unknown
  Kingdom: Bacteria, Phylum: Actinobacteria, Class: Actinobacteria, Order: Streptomycetales, Family: Streptomycetaceae, Genus: Streptomyces
ggcgtgcacctctgacatggttcgagcgtacgagcgggggtggcggcccgcccggccagcgcacccgaccgggggccggacgccggagcgccgcgcggccggccgccgtcgggggtctcccggccctgcggaccttccgacggctaccaggcgggcgggctcgcgatggagcgggccagtacgtcgtccaggacgcgggcggtggtctcgacgtcgtacgtggagttgtcgatgatcgggaggccggagccgtaccagccggccatccggccgtggatgcgggcgacctcctcgtcggagagcctgcggttgccgctgcgggcggcgttgcgctccaggacgatctccaggccgggcagcaggaccacgggcagcaggccgggacccacgtggcgcttccagccgccgaggcccacgaccgggcggtcggggaagacggcgtcgtcgaggatgcaggagatgccgttggcgaggaagttgcgggcggcgaagccgcaggtgcggcgggccaggcggtactgggcctcggagtggtcgttccagccggcctgcgggtcggcgaagccggagcggacccattcgcggacgtcgtcgagggagacgtgggcggtgggtacccgccggcgggccgcccagagcttggcgacggtggtcttgcccgccccggccgggccgatgagcagcacggcgagcgtggcgccgccggtgccggagcctgcggggggcgcgggcagcggaacggggccgcccgggggcagctggacgtgcccggtgtgcccggtgacctgcccggcgggcggccccgttc

SEQ ID NO: 4542 - DNA, 1348 bp, Unknown
  Kingdom: Bacteria, Phylum: Actinobacteria, Class: Actinobacteria, Order: Streptomycetales, Family: Streptomycetaceae, Genus: Streptomyces
gcccggaagccgtcggcgtgcacctgggcggcgaggacgacggggccggtttccaggacggacagccggtgcgaggggcggccctgggatccggccgccgatccggggctggagtcgacccggatcagcccgagcgcctccagttccgcggcgaccgcaccggcggtggcgcgggtgacgcccagttcggaggtgagcacggcccgggtgggggcgcgtccggtgtggaccagttccagtgcgggcccgagcgcactgcggcccctctccaacttcgtccgggtggtggtcgccttgccgttcatgggggcgagtctcccatgatccggacacgtcccggacgcccagggcctgtccggggaccccgttccggccacggccgagccctcggaacgtacggcgtgcagcggtgttgcgcctgtcgccggagcacccctatgctgagtttgtgccgcaactaaacaaactgcggacggccctaccggggggacctggcggagacaccgccccaccctcgtcggcccgcctccgtaccgcgctgaccgtgttcttcgccctcgacgggttcctcttcgccggctgggtggtccgtatcccggccatcaagcagcagaccggagcctctgcctccaccctcggcctcgccctgctcggcgtctccgccggtgcggtcatcaccatgatgctcaccggccggctctgccgccgttacggcagccatgccgtcaccgcggtctgcggcgtcctgctccccctgagcatcgccctgcccgcccagacccactcggcgctctccctcggcctcgtgctgctggtgttcggagcggcgtacggcgggatgaacgtggcgatgaacagcgccgccgtcgatctggtcgccgaactgcgccggcccgtgatgccgagtttccacgcggcgttcagcctcggcggcatggtcggcgccgggctcggcggactggtcgcgggaggcctctccgcgtccacccacctcttcctgctcgccgggaccggcctgctcgtcaccgccttcaccgggcccgccctgctgcggcaccgcccggtccccgccgctccgcgggccgtcgaccggcgagcgccgaagcagcggctgtctccccgggcccgccgtgtcgtcgtgctcttcggcgtgatcgccctgtgcacggcatacggggaaggagccctcgccgactggggcgcactgcacctggaacaggacctgggcgcgcaccccgggctcgccgccgccggatacgcgctgttcgccctgacgatgacggcgggccggctgaccgggaccttgctcctggagcggctcggccagacccgcaccctcgtcctcggc

SEQ ID NO: 4543 - DNA, 725 bp, Unknown
  Kingdom: Bacteria, Phylum: Actinobacteria, Class: Actinobacteria, Order: Streptomycetales, Family: Streptomycetaceae, Genus: Streptomyces
gctgggagcgctctccacgcggctgcgtggaccgctcaccgaagcacggccgccgggcggtcgcggcgggtggccagggagccgcggtggcgtcgggcgtgaagtaggacgcccggcctaccgcggcctcacctgcttccactggcgatggttcttcagcaaaccatcgcgtcacgaacgcaagaatatggcaatagttgcgggacgtttatcgccccgtgatggacatggccgcccggagacggctgcgaccgaggttccggcctgtggcccacgaccctccctagcgggccgcggcggccgtccgcaccgtaccgaagtcgatggcgcggtcggcctcgcgcaggacctcctcggccactctgcgaacttcggcgggcacgtcgccgtgctcctccacgaggccggcgtagatcggtgcttcggtgctgtctgcggaactcatacggtttttccccgtcggtctggtgcgaaaagccccctgccggtcggcggaggcgggggcgagtgtacgtggtgggcggcggcggtcgcgattccattccggcgcgcggaccccgccgcacctgctggaacagcaccccaccccgccccggcgggtgcgggcagcggctccgtcagtgctgcacgggaaagcccgcacgggcggcgagcgcggtcagctcgtcggcacgggccgcccgcaggcccaccaccggatagcagtcggactcgatgtcgaggac

SEQ ID NO: 4544 - DNA, 1028 bp, Unknown
  Kingdom: Bacteria, Phylum: Actinobacteria, Class: Actinobacteria, Order: Streptomycetales, Family: Streptomycetaceae, Genus: Streptomyces
tgtcaccgccttgggtcaccggtcgaacggccaccccccagagtgcccctgtcggggcccggccggaacccccgccgccgtcccggtgcgggacccgccccgtaccgtggcggccatggatcacgagggggagatacccatggaccaccgcgacgcgagcgccgtgcccggctccggcgggctgcggctgcgccggtggcgcgaggaggacctgcccgcgctgctggaggcgtacgaggatccggcgatgcggcggtggctggccacccaggtctccggagcggacggggcggccgactggctggaggcgcagcgcagggggtgggcgacgggcacccgcttcgccttcgccgtgacggaaacggcgaccgatgcccgccgggacggcgggccggtcggcgcaccgctcggcaacatcgtgctgaagcggccggatccgcggaacgactgtgcggaggtgggctattggacgacggccgccgcgcgcggccggggcgtggcgtcatgggcgctgacggagctgaccgactgggcgttcgcggagttcgccgaacagggcctgaaccggctggagttgcttcaccaggtggacaacgaggcctcgtgccgggtcgcggagaagtgcggatacgcactggcgcgggtgatccccgcgctgccgccggactatccgctggacggccatgtgcatgtgcgcgacgctccctcggtggcgctcagccggccggcgggtcgtcgtgcagaagccgctggaacaggtggtggtcgcgccagcggccactgatgtgcagatagcccggcgccgtgccgatccgctcgaacccggccttggcgagcacccgttgggaaggggcgttgtcggtgacggtcgccgcttcgacgcggtgcaggcccagccggtcgcgggcggcctcgcagaccgcgccgacggcggcggtggcgagaccgcgtccggcgtggtccgcgtcgacccagtagccgaggcgggcgttgcggaaggggccgcgctcgacgccggagagcgtgaa

SEQ ID NO: 4545 - DNA, 828 bp, Unknown
  Kingdom: Bacteria, Phylum: Actinobacteria, Class: Actinobacteria, Order: Streptomycetales, Family: Streptomycetaceae, Genus: Streptomyces
cggccaccgcgtccgccaggggtccgatgtccgccgcggtcagcggggagacggtgatccgcacccccgggggcgtgtccagccggaagcgggctcccggagccgcggcccaccccgcgtggagcagccgggtgaccgctccggtctcgtcgctcacgggcacccacacgttcatcccgctgcggccgcgggccaccacgccgcgctccgcgagggcgtggacgagcgcgtccctgcggtcgccgtaggaacgggacaccgcacgggtgtcgatggcgtcggaggtccacagatggagcagggcgcgttggagcagccggctgacccagccgggcccgagccgttgccgtcccaccacccggtcgaccgtgacggcgtccccggtgagcgtggcgacccgcagatcagggccgtacgccttggccgccgagcggatgaacgcccagtgggccgtcaccccggccagcggatgcaacggcaggtcgacgatggcgtgcccgtggtcgtcctcgatcagcagcacgtccgggtggcgcccgaggaccgcgcgcagctcccgggcgcgcggctcatccagggacgcaccggtcgggttctgcgcccggtcggtgacgacgagggcccgcgccccggctcgcagcacccgctccacatcggcggccagcggaccggagtcgtccactccgaccggtacggcacgcagcccgagcgccgcgacgaggtcgatcacactgccccagcccgggtcctccaccgccaccgcgtcgcccggccggaggtgcgccgcgaagacccgctcgatcgcgtccagggctccggacgtcacgg

SEQ ID NO: 4546 - DNA, 766 bp, Unknown
  Kingdom: Bacteria, Phylum: Actinobacteria, Class: Actinobacteria, Order: Streptomycetales, Family: Streptomycetaceae, Genus: Streptomyces
ccgtgtcgtcctgcgcggtcctcgcgctgaccgcgcaggacgacacggagctggcggccgaggcggtacgggtcggggcgcaggactacctcttccggggcgagctggacgcgcgcgtcctgagccgcgccatccggtacgccgtggagcgcaaacgcgccgacatcgcccagcaccagctgaccgagtcccggctgcgtgcccaggagaacgcccgcctggaacgcggcctgctccccaccccactgctggaaggctccggcctgagcttcgccgcccgctaccgccccggccgcagccgtgccctcctcggcggtgacttctacgacgtcgtccgcaccccggacggcacggtgcacgcgatgatcggcgacgtctgcggacacggcccggacgaggcggcgctcggcgtcgagctgcggatcgcctggcgggcgctgaccctggccggactgtgcggggacgagctgctctccacgctccagcaggtgctggagcacgagcggcagagcgaggagatcttcgcgacgctctgcaccgtggacatcgcccccgacgggcgacgggccggactctgcctggccggacatcccgcgccgctgctcgcccgccagggcctgcccgccgggctgctcccgcaccaggacggcggcccggccctggggctgctgccgagggcccggtggccgcgccggcaggtcgagctgggcggcgcctggagcctgatgatgtacacggacgggcccatcgaggggcgcgtggggac

SEQ ID NO: 4547 - DNA, 582 bp, Unknown
  Kingdom: Bacteria, Phylum: Actinobacteria, Class: Actinobacteria, Order: Streptomycetales, Family: Streptomycetaceae, Genus: Streptomyces
ggcgcggacatcgtcctcgccctgcctccggcgttcgccgcacaggtcgccaatctggtcgccggcacgacagcgcgcccggtctggtacccgctgggaccggcggaggtcgccacccaccccaccaccggggccgtccacctcgtggtgcgccggcgggccggggaggccggaccggactggaccacacccccgccaccgcgggagcccggactgcccggcgcccgtgacctcagcagcggtgacagcgacaccgacgacggctccgacagcgacgacgggagcgacagcggctccaccatcgacggcgacgcggagttcgaccggctggccgacctcgcccagttcgaacgccgggtcgacgcgctgcgccctcgtcccctggtcacccgcgcctacgaggtcctcgacgacagcggcaccggagtgctgttcaccgagcccgggccccggacggtcggcgaagtccgtacggcggagggggccgagggacccgcgctggtcctgccccaccagacccggggggtcgtccccgccgccgaccggccgccgctgcacatctccgaggaccggacggtcgcg

SEQ ID NO: 4548 - DNA, 1043 bp, Unknown
  Kingdom: Bacteria, Phylum: Actinobacteria, Class: Actinobacteria, Order: Streptomycetales, Family: Streptomycetaceae, Genus: Streptomyces
  misc_feature (683)..(684): n is a, c, g, or t
gctccgagtcctccggcggaaagggcggcaagcgccgcgggagcggtctggtggcggccgtggccgtcgcggccctcgtcgcgggcggagtcggcggagccctcggtttctgggcggccgaccggaacgacgacggcaacggcggtggctcgaccaccatctcggcgtcggacaccccgagggacctgaagcgtccggcgggcacggtggccggggtcgcggcgaaggcgctccccagcgtggtcaccatcgacgcgcagggcggcgacggcgagggcggcacgggcaccggcttcgtgtacgacaaggaaggccacatcctcaccaacaaccacgtggtggcctccgccgcggagtccggcgaactgtcggcgaccttctccgacggcaagaagtacgccgccgaggtggtcggccgggcgcagggctacgacgtggccgtgctgaagctcaagaacccgcccgcgggcctcgccccgctgccgctgggcaactcggaaggcgtcgcggtcggcgactcgacgatcgcgatcggcgcgcccttcggcctctccaacacggtcaccacgggcatcatcagcgcgaagaaccgcccggtggcgtccggggacggctccagcaacaagaactcgtacatgagcgccctgcagacggacgcctcgatcaacccgggcaactccggnncggcggccaaggcgggcctgaaggcgggcgacgtgatcacgaagttcaacgacaccgtgatcgacagcggcccgaccctgatcggcgagatctggacccgcaagccgggcgagaaggtgaccctgacgtacgagcgggacggcaggacggccacagccgaagtcaccctgggccagcgcgagggcgacagctgaccggctaggctgtcccacgcgtcgaaccggccccacgcgggcctgacggcccatcggcttgcacagcgaccggaccgccgacgcggggtgggttgcccgagcggcctaagggaacggtcttgaaaaccgtcgtcgcagcgatgtgaccgtgggttcaaatcccac

SEQ ID NO: 4549 - DNA, 666 bp, Unknown
  Kingdom: Bacteria, Phylum: Actinobacteria, Class: Actinobacteria, Order: Streptomycetales, Family: Streptomycetaceae, Genus: Streptomyces
ccccggccgcgacggtggcagcggacggcgaggtgctcgtcgcggtggcgcgcaccgacgcccccctcgacgaggtcatgcggacgatccagcaggcgctcaaggaccgctgagccgggcgtcctgctcggctggggccgccggcgcccagggcggcggcgcggcgccctggctccaggcggccagctcctcggggccgtaacagaggatggcgcactgctccgcgtagtcgagcgcgggctcggtgaagcctccggtggacacgacgagtgcgacatccgcctcgtggaccgcgtagcaggtgccgccgaagcgctggagctcctgggagccggcccggttctccgggccgtagcgcttgcactggacgaccaggcggcggccgtccggggtggtggccaggacatcggcgccgaggtcgcccgcgccgcccaccacctcggcgtccgcgcagccgtcgcgtcggcagagttcggccacggcctcctcgaaggcgtacgggtccagctcagcgtggtcgaccggctcggcggcctccgggggcgcggcgcgatcccgggcccgggccgcttccacggcgtccagctccgccagacccgcgtcgacgatcccgtacgcggcgtccgtgagggtccccgcgacccgccgcgcccgacgacggcggcg

SEQ ID NO: 4550 - DNA, 566 bp, Unknown
  Kingdom: Bacteria, Phylum: Actinobacteria, Class: Actinobacteria, Order: Streptomycetales, Family: Streptomycetaceae, Genus: Streptomyces
acccgcgcacgagggtgtcgtgcggcggggagctcgtgctcgccgccctgtccgctctgcgtcaccaggactcctacgtgtgaacctacggaaccgtcggctcacgctatcgggtggtcacccgcctccgccaagcgcgtggtgcccctcacgaccccttcacagggccggtaacatcccgccgccccgcgacgctgttaacggccggaccgccacgaacacggcccggaccgcatcggcgaccacccgtcctcaggccgcctggagctccagccgctccccgaactcccgcaccgcgggctcctcgccgtagggcgtgagccgctgctggaggtcgtcgagatattcggcaccccggctggagcgcaccgtcgacagcagctccatcgcccgggtgcccgtctggcacgcccgctccacctcccgctgctgcacctgggcggaggccagcagcacgagcgcgatgccccggcgccgggcccgggtctccggcagtgcggccagcgcctccttggcccgccgggccgcctggtccggctgccccaggtcccggtggcagtgggcca

SEQ ID NO: 4551 - DNA, 535 bp, Unknown
  Kingdom: Bacteria, Phylum: Actinobacteria, Class: Actinobacteria, Order: Streptomycetales, Family: Streptomycetaceae, Genus: Streptomyces
tgaccggacactcgctcctggccggccgtgaggtccccggcaccggggacgcctggtacgcggtcgccgccgcgaccggcgagccgttcggccctccgcaccgggacgcctccacggaacaggtcgccgaggcggcccggctcgccgcggcggacgcccgcgccttccgcgccctgccgcccgagcggcgggcggccttcctcgacgcctgcgcggaggagatcgaggcgctcggcgacaccctgctggaactcgcggccagggagaccggactgccggcggcccggctgaccggtgaacggggacgcacctgcgggcagttgcgcctcttcgccgagctcgtcaggagcgggagcgccctcggcgcccggatcgactccgggccctcggggacggacgtacggctccggcgcgtgcctctcggcccggtggccgtgttcggtgcgagcaacttccccctggcgttctcggtcgcgggcggcgacaccgcgtccgcgctggccgccggctgcccggtggtggtcaaggcccaccc

SEQ ID NO: 4552 - DNA, 1039 bp, Unknown
  Kingdom: Bacteria, Phylum: Actinobacteria, Class: Actinobacteria, Order: Streptomycetales, Family: Streptomycetaceae, Genus: Streptomyces
gtgtgggggtgccgggtacgccggtgggggtggccgtggccgggacgtacgaggggaggacggcgaggaggacgtggccggtgtgctcggcgagccgggccagcagcccgtcgggggcgtgcagtgcgggggtgtccgcaatggagtcgacgacggcgaccaccgcgtcgaagccggcgcccgccacgttgtacgcgtaccggtcgccggggccgtcggccgggtcgtcgtgggccgggaagacgatgcgggtgcgtatcgcgtagccggggtcgtcgacggccaggacgggtgagcgggtggtggtggagtagcggacctcggcgtcggctccgagcgcggcttcgagcgcggtgccgaggcgcagcggggcgtacatcagctcctcgaagccgaggacgaggacccggcggggagtggggccggtttcgtcgcccaggccggccgcgatccggtccgccatggccgggagcgcctcttcgagggccgcccgatgggcgggggtgaagccgtgccggcctccgtcggggacgcctgcgggccagtccaggtcgacgcgggtcacgggggcggggtccatatccacgacggcccctgcggacccctcgtcccgacccgcctgttccgcctcctgggccgcgaccagggcctggccgcgttccagcacgccgtccggcagggcgaccgttccggtgctgcgcgtcaccaggtcgacgcgggcgccgatctcggcggcgaagacggccagtcggtcacggtcgccggccgagcgcatgtcgaccagggcgacgatgacgtaccgctcgcgcgggtgcagggcgtgcagcgcgcggatggtgttcaggaccgtgttgccggtggagaactcgtcgtcgaccagcaccagcgcggaggcgtcggaccccgccccggcgcctgccagcaggtcgcggtcctccggcagcagcaggtgcgaggtggcgtgcgagtgcgactcctcgaagccgcccgcctgctcgacgcccgcgaccgggcggcgggtggagtgcaggtacggggc

SEQ ID NO: 4553 - DNA, 545 bp, Unknown
  Kingdom: Bacteria, Phylum: Actinobacteria, Class: Actinobacteria, Order: Streptomycetales, Family: Streptomycetaceae, Genus: Streptomyces
gcctcgtcggcgggggccagcagggcccggcagcgggccagttgggcgggtgcccccgggtcggcggtccaggccgcccaggacgcgaactcgtcgacggcggcctggagttcacgggactcctcgggcagtcgtccgcccaggacggcggcctcgacccagcagggcacggcgagcatccgggcggcgaagtggccccgtgcgggaccggtcccgacgaggggggccagccgggcggccgcctcgccgggccgcccggaggccaggtccgcgcgggcccgtgcccacgtggcgagcgtgacggcctgggccagaccgtgcggccccgctccggccagcgcggcgtctccgtgcgccgcgcacgcctccgcgggtccctccacggaagcggcgagggcgagcacggcgtgcagatgggcggtgctgttgggctgccccgtacggcgggcggcgtgcaacccttccagcgcgtgggcccgcgcaccggcgtgccgcccggcccgcagttcggcgtaggcgaggtgttcgagggcctggggcagcag

SEQ ID NO: 4554 - DNA, 975 bp, Unknown
  Kingdom: Bacteria, Phylum: Actinobacteria, Class: Actinobacteria, Order: Streptomycetales, Family: Streptomycetaceae, Genus: Streptomyces
cgcaggggccgacgtccgcggcctcagccgccgctcccctcgtacgccgtcgatctgcgcgacggcaggggactggacgcggcggtcgagggggcggacgcgatcgtccactgcgccacgacccgcgcggcggcgacgaccgggcggcggggttcctcatcgacgcggcgaagcgggccggtacgccgcatctgctctacatggcgaacagcgcgtcctgcgccgcgtcccgggcggtgatcagcgcaccgcgcagcacggccccgtcgcccagcgagccggcacggacctcggtccgcaggggtgacatcgcggccagccgctcctcgacccgggcggcgagcgcggcgccgcccacgtggccgacggcccccgcgagcaggacgcagccggggtcgagcaccgagacgaccgcggcggcgccgagagcgaggcggtccgccagctccttcaggaagggctcgcccgcctctcccgcctccagggcggtccgcaccgccttcacggccgccgcctcctcccggccgtcggtcaccgcgccggggtccaggaggccgtgcgcggcggcgagttcgcacagcgcggcggagccggccagcgagtggaagccgccgtcgcagttgaccgccgagggcagcccgctcactccggggacggggaggaacccgatctccccggcaccgccggacgcaccctgacgcagcttgccgtccagcatgacggcggccccgatcccctggccgagccagagcaggacgaaggtctcccggtcgcgggcggcgcccgcccggtgttccgcgacggccgcgagattggtctcgttctccaccaggacggtggcgggcagccgccgctggagctcccggaccaggccccggtgccaggcgggcaggccggtgctgtcgcgcagttcgccggtgacggggtcgatcagccccggcgctccgaccccgacgctgtgcagggggacggatc

SEQ ID NO: 4555 - DNA, 548 bp, Unknown
  Kingdom: Bacteria, Phylum: Actinobacteria, Class: Actinobacteria, Order: Streptomycetales, Family: Streptomycetaceae, Genus: Streptomyces
ccgccacgggcccagcccgtggcggcggtccgggcggagcgggaccgtggtcacggtcgcgtacatccgccccatctcctggtggcggtggtattcggcgcaggcgtattcgaggacgacctcgtcgccctccgcgagggtgccgtacaggaccgcctcgaagggctcgtgcttcgggtcgatgtcgtggtgcccgttccccaccccgtacgccgagccgctgcccaggagccgcgtcctttcgcgggtgtcgctcttgcggggggtgtacgcgatcaggggggccgccgagcgggtgcgggcgtccgcgcacacccagtggcgtccgtccgccccggcgcgcacacccacgatcagggccggctgctcctcctcgcacagtcgtcgcgccgcccggtaggcgagctggccccagccgccgaaggtcgtgcctgcggcgaggagcaccagaccgatgcgctgctgcccgacggcgtcgtacccgacgccacccgaggtcaggtcctcgaccaggccatcggccaggatgcccgcacccgctcggcggc

SEQ ID NO: 4556 - DNA, 1173 bp, Unknown
  Kingdom: Bacteria, Phylum: Actinobacteria, Class: Actinobacteria, Order: Streptomycetales, Family: Streptomycetaceae, Genus: Streptomyces
gtcctggccggtcgccggtgcggagtgcgggccgaccgcgacgacgtcgccgatgacgatcacggcgggcgggcgcacgtcctcggcgaccggccaggaccggccgggcgaccagccgtgaggtaacccgcggttacctatctccatcccaggcgttggcaccacacaccggacaaggcagtatcaccctgtggcagatctcatcaccgtcgacgaccctgacgacccgcggctgagcgactacatcggcctgaccgacgtcgagctgcgacgacggcgcgaacccgccgaaggcctcttcatcgccgagggagagaaggtgatccgccgcgcccggcagaccgggtacgagatgcggtcgatgctgctctcggccaagtgggtcgacgtcatgcgcgacgtcatcgacgaggtcccggccccggtgtacgccgtcgcccccgagctggccgaacgggtcaccggctaccacgtccaccgcggcgcgctcgcctccatgcagcgcaagccgctgcccgcctccgacgaactgctcgccaccgcgcgccgggtggtggtcatggagtcggtgaacgaccacaccaacatcggcgccatcttccgcagcgcggcggccctgggcatggacgcggtcctgctctccccggactgcgccgaccctctctaccggcgctcggtcaaggtctccatgggcgcggtcttctccgtcccctacgcccgcctcgaagcctggcccaaggcgctggaatcggtacgggaggcaggcttccggctcctcgccctcaccccggacgccaaggccaccagcatcgacgaggcggccccgcaccgactggagcgggtggcgctgatgctcggcgcggagggcgacggactgtccacacaggccctgatggccgccgacgcatgggtccgcatcccgatggcgcacggcgtcgactcgctcaacgtgggcgcggcggccgccgtcgccttctacgcggtgaccacgggacgcccggagaactgagcacggtcagccccctgccgaccctccgtcaggacgcccgcatcagctcctgaacctgcgtcggctcctgcgcctgcgggtcccgctcctgctgctcgattccagtgccaatcccggtgccgggatcggtgccgcccagaccacgcgccggcccctggcagccc

SEQ ID NO: 4557 - DNA, 607 bp, Unknown
  Kingdom: Bacteria, Phylum: Actinobacteria, Class: Actinobacteria, Order: Streptomycetales, Family: Streptomycetaceae, Genus: Streptomyces
gtgcggcggcggatctcggcggcgtcggctgcggggctcatcgggcacctccgggcagcacgacgatgcggccggtgctggtgccgtcggcgacgcgctgaacggcgtcggccgccccggccatcgcgacgcgctcgctgaccagggggttgacgatgccctgctcggcgagcttggtcagttcgtcgtggcaggcgcggacggcggccgggtccttggtgttgtacaggccccagtgcagtccgacgacggagtagttcttcaccaggacgtggttgaggcccggggtggggatgacgccgctggcgaagccgacgacgaggatgcgcccctcgaaggcgacgcacttggcggacttggcgtacgcgtcgccgccgaccgggtcgtagacgacgtccgcgccgcgaccgccggtggcttccttcacggcggcgacgatgtcctcgctccgccggtcgatgaccaggtcgcagccgagctcgcgggcgaccgccgccttctccggaccgccgacgacgccgatgaccttcgcgcccgccgccctgccgagctggacggcggcgctgccgacgcccccggccgccgcgtggacgaggagggtctcccc

SEQ ID NO: 4558 - DNA, 651 bp, Unknown
  Kingdom: Bacteria, Phylum: Actinobacteria, Class: Actinobacteria, Order: Streptomycetales, Family: Streptomycetaceae, Genus: Streptomyces
gacccggcgtacgcccccccgaacggcggcggggccggcccctcctcggggtcgggcccgccgccgttcgggggggcgtacgccgggtcacatgatgcggtacgccaggtagtacgcggacagttgctcgtggtagcccgggtcgtcggcctgtcggtggcggtcgaactccggggattccttgacctgttccttggtgaggtcgacgtagaccttccggtcctcggtgtcgatgcgcttcaccgtgccggcgggcagcaggacgtccttgccgaagatccagactccggtgtcgacgagcagataggccgaacccacctcgtcggagtgcttgtcgacctttccgatacttccgtcggtggcctcgaccgagtagccggtcaggtcggcgccggcagtgtgtccgctcgacggctgatatccccacagggagtcgctcattgtggctcctttcgtgaaggtcgcccagtgcattcgtgtctgctggatcggaaatgcactattgatttatccaccgaacgatatttccgctgaacttcgtgtgcccggggagaggtggcgtacacctgggcggtgccgctggacagcggcagatgctggtcagaagtgactaccagcggtaccaccggccccgtcggccgccgctcgcgg

SEQ ID NO: 4559 - DNA, 724 bp, Unknown
  Kingdom: Bacteria, Phylum: Actinobacteria, Class: Actinobacteria, Order: Streptomycetales, Family: Streptomycetaceae, Genus: Streptomyces
ctgcgggtagccgtagccggtctgctgcgacggggccgcgggcagagcgggcagcgccgacggcagggccggcagatagctgttgccggtgtcataggcagccggcacccggatgggggcgatctgaggggttccccgctccgcgaccaaggagtcgtagatcggagtgtcggagaacgacgcggcgtagtagccgccgccgaaggtggagcggggggacgtcatgccacctaagttaagcccacgatgtgctgtatggggagccccaatctttgggttatccgttttacgctgtttctgtgcgcccggcctgccgaaacatcgttaaacctttcgttaacagcagggacctttccgctggtgggcgacggcttcggcccgcgctcccgaggacgaaggggaacggcgtcgacgcatccgggagggaagcgaatagcgtttggccaaagggcgttgcgcacggttcggcgtcgcggagatcgtcggccggcccgaaaggccccctgccttccctctgcgctcgtagggtttttggcaccgccctcacccgcccggtccggtgggaccgctcgtgcggggtgcgcggcgcggggaccggtcggccaccggcaggaccaacagggcggccggcccgctcatcagggccggtgccgggtagccgtcccgcgcgacgaccgggcccgacgccaggcttccggccgctccggcggtcgcgagacccacg

SEQ ID NO: 4560 - DNA, 708 bp, Unknown
  Kingdom: Bacteria, Phylum: Actinobacteria, Class: Actinobacteria, Order: Streptomycetales, Family: Streptomycetaceae, Genus: Streptomyces
cctccagcacctcgatcggcttcgtccacgcggtacgggagctgggcgccggccgggccgcagtcgccgccccctaccccgaggacgtcaccgggctcttcgtggagttcctggcgtcggcgggcgtcgaggtggtggccgccgtgtccggcggggccgtctcgtcggccgaggccgggtcctgggagccggagcgggtgaagcggctggcgcgggaggccgaccacccggacgccgaggtggtgctgatcccggacacctccctgcacaccaccgcgtacgtccccgagctggaggaactgctcggcaagcccgtcctcacggcgaaccaggtcacggtgtgggaggggctgcgcctcaccgaccgccggacctgggcccccatgctgggcaccctgttcgccacccgtgagccggtgctgaggtcgctggagccgaagggcatcgaagtgcgggagtagcttcgcctctcgtcctccgccgcctcgcctctcgtcctccgctctctcgcctgtcgtctgccggtcgtcggcccccggtccgctcccgggtgacgtgcgggaataaacggagtcatcctcctgttggactcctccgatacacagccgtacgacagcagcaccgggagaggccgacacgtggacgagatccgaggcgacgagacccgcagcgacacgagtggtgacgcgagcggcggcgcggccgacg

SEQ ID NO: 4561 - DNA, 860 bp, Unknown
  Kingdom: Bacteria, Phylum: Actinobacteria, Class: Actinobacteria, Order: Streptomycetales, Family: Streptomycetaceae, Genus: Streptomyces
ccccttgaggggccgggacgggggcgagcgggtcaggcggccggctggagcaggtcccagcggttgccgtagaggtcctcgaagaccgcgaccgaaccgtacgtctcgtgccggggatcctccaggaaccggaccccggccgccgccatccgggcgtggtcggccgcgaagtcctcggtgtgcaggaagaacccgacccggccgcccgtctgtgcccccaccgcctcgctctggacctcgtccttcgcgcgggccagcagcagccccgtgccaggagccgcgccgcgcgggcgcaccaccacccagcgggtgccgtcaccccggtcggtgtcctccaccagctcgaagccgagcgcgtcgcggtagaacgcgagggcctcgtcgtagtcgcggacgaccagggtgaccagggcgatgtgggacatggcggaggcccttccacgggtgctgaaccggtgctgaacgagtacagcacggatgacgttatacgtaacactaacgctttcgggtccggcccccgcacaatgccccgcatggacatcctggacggcacgaccaccggcggccgggccgcgctgacgtaccgggcccgcgccctcgcggacaccggagggcggtgtgtgctggggatcgcggggccgcccggagccgggaagtccactctggcgcaacggctggtcgcggcgctggacggacgcgccgccctcgtcccgatggacggcttccacctcgccgccgccgagctggagcgcctcggccgcgccgaccgcaagggagcccccgacaccttcgacgcggccgggtacgcggctctcctgcggcggctgcgggcgccggacccggtgcacgcggtctacgtc

SEQ ID NO: 4562 - DNA, 1054 bp, Unknown
  Kingdom: Bacteria, Phylum: Actinobacteria, Class: Actinobacteria, Order: Streptomycetales, Family: Streptomycetaceae, Genus: Streptomyces
gtgctggaggcgggcagcccggcgctccgggcgagcgtggcgacctgctcgtgggcgcctttccagccctgcccgaagctgccgccgctggaggcccagagcagagcctccgccccggcgagacgcagttcctcgacgccttcggcgatccgggcgggggcgccctgctcgcgcagcgcgtcggcgcggtaggcgtcgtccccggtttcggtggagaacaggggcagccggatgtcggtgtcgagcaggatctcggtccgtgggaagtcgtcctcggcggcgtggcccgggtagagaagtcctacggtcgtcatgtccacccttcctgtgcgtcgacggctcgccgcacggcgggcgaccccgctgcgggggtcgcggcggccctccggacgctccggcggccgtgaccgcgcgaccggtcactcttgccccgacttgttcccagtattcccccggtcgagcaccggggcgcgcggccgggcctcgttgacgaagggggaggctgctgcgagcgtgggcgatccgtacgtccgctccaccgcggagggctgaccagcgatgccggatcccgtcctgctcgtcctcgacgccgcgccctccccgcggctcggccggctgaccggccgggtggacgtgcggcacgcggacgcctcctcgctcgccgggctgctcccggccgccgatgtgctgctggtgtgggacctggcgtccgacgcggtgcggaaggcctggccaggaccggggagccggccgcgctgggtgcacacggcgagcgcgggcgtggaccggctgctctgcccggagctggtcgcgtccgaaacggtcctcaccaacgcgcggggcgtcttcgaacggccggtcgcggagtgcgtggcgggtctggtgctggccttcgccacggatctccccggcgtcctggagtgccgacgggagcggcgcccgcacgaccgggaggggcagcgggtcgccggaacgcgggcgctggtggtgggcgcggggccgatcggccgggagatcacccggctgctgcacggcctgggggtcacggtggcgc

SEQ ID NO: 4563 - DNA, 619 bp, Unknown
  Kingdom: Bacteria, Phylum: Actinobacteria, Class: Actinobacteria, Order: Streptomycetales, Family: Streptomycetaceae, Genus: Streptomyces
gtctcgacaggtgcggggcgcgtagcgctcccccgccccgcacctgtcgagaccgctaccggtccgcacctgccgaggcagctcccccgtccgcgtcttctgaagccgctcccccggtccgtacctcctgaggccactgcctccggcccggggcccgggtggccacccgtccctcgcggccgtccgaacccaccggcccggccgcccttcccggtctcccggccgtgtgccgacatacgccgacgtgcggcgggaccggcacgtgtccacggtccggcgccgagcccccgcaccggattccggtgccgtcccgtgctcgcgtcatgggccgtataccggcgtcgggccgacgatcaggcgttcccataccgcgcatccgtacgttccttctcagccggtgcaaccgacaccgtcgacagaggagaagaacatgcctgagaaccagagccaggagccgaccgaggccgaggacttcgaggtcgtggcgcacagcgaggacggcgaggacgaggcgggcgtctgcgtcaccaacaacagcgacatgctgcagtaactcgtcccgtcgagttctgttcaccgcgcgggccccggcgctcggaccgaccgttccgggcgccgg

SEQ ID NO: 4564 - DNA, 956 bp, Unknown
  Kingdom: Bacteria, Phylum: Actinobacteria, Class: Actinobacteria, Order: Streptomycetales, Family: Streptomycetaceae, Genus: Streptomyces
gggcgagcgtgccgacgtcgccgaccgcctggccgacgaccgggaccgccaccctgaccgcgtccgcggcgagcggcggcagcacggagtcggacgtctgcccgaccacagggccggcttcggccagcgccccctggacggcggccggcgcctggttctgcgcgtagccggggatctgctcgatcggcccgaagaggtagtcgatctcgtcggccggcgcagcgggaagctccactgccccgggggcctgtcgtacgtcgccgaggtccggaacctccggggtctgcggcgtgcgcacctgtgacgggaagccgtccgaagagaggcggtccgacgggagacggtcccgtacgtcggccgcaccggcggccttgtccccggcctccgtcagcgtgtccttcacggcgtcgatgccgtcgccgctcttggcgtcctggagaacctcggcctcggtgacgtccttgacggtctccgtcgcgtcgggggcctcggccgccaggtccggggtggagagcggtacggacacgggcagctcgtccgcgctcgccgcagcggtgccgagcgcccacatgccggtggcggtggcggcgacggctatggatcggcgcatgttcttgtgcatgggtgtgtcagatccttcgaagatgttcggcagtccggagagctccggacgcgggcagacctgttccgcccccgcgcggcaggtcgaggcggggggaatggcctgccctagccggggaattcgaggatctcgccggatctgtcggatgtcggggcggcggtcgccgggaggcccgctccccggacgagcggggtgtacggaccacccggtgtccggaccgcgtgcaggtcgccgccgcgcggcccctggacatcggccgccgccgtacgcacgaggtcgccgcagggaccgaacggcacacggcccggcgccggcgtgggctcggaaccctgtg

SEQ ID NO: 4565 - DNA, 919 bp, Unknown
  Kingdom: Bacteria, Phylum: Actinobacteria, Class: Actinobacteria, Order: Streptomycetales, Family: Streptomycetaceae, Genus: Streptomyces
gtgtccccgtccccaccggcaggccgggggtgcgtcaccccccttgcgcacccccggccacaccttcccggccacgccttcgggccgccctccccttccggccctccgacaggggggcgtcacagctccttggccggccagtccaggagccgggctccgatgaccgccgtctgcagggtgtagcggtgcatcgggtccgaagggtcggacccggtcaactggtggatgcgctccaggcggtacgtcagcgcgcgtacgctcagcgtcagccggcgcgcggtctccgcggcgacgcagcccgcgtcgaaatagaccgccagcgtgttcagcagcggctccgcaccgccccgcgccttctggagcgggcccagctcactgcgcaccagatcggccatcgcctgccggtcccgggtcagcaccgggtagaccaggaggtccgaggcgtacagcacggggtcgtccatccccatccggtccgccagatcgagggcttcgagcgcctcgtcgtacgagtggaccaccccgccggggccctcgtgcggtcggccgaccgcgacctggccgccgtccgtcgccgcgtgcgcctgcttggcgaagtagcgcaggacgtcgggctgactgcccggcgcgatgcagacgatccggccgtccttcgtcgtcagcaggatcttgcggccgctgaaccgcgtcagcagcgccgcctccacactgcgcggcaccgcgtccgtctccgtgtacgcctccgggccggacgccactgccaccgcgtgcgcccgggaaagtcgcaggccgaagcgggtcgcccgctccgcgagccgcaccagatcgctgcgcccgtagagcaggtcgtcgatgaactcccggcgcaccgcctccgcccgcagcaggcggcgagccgggagttcatcgacgacctgct

SEQ ID NO: 4566 - DNA, 735 bp, Unknown
  Kingdom: Bacteria, Phylum: Actinobacteria, Class: Actinobacteria, Order: Streptomycetales, Family: Streptomycetaceae, Genus: Streptomyces
ccctggccgccggcgtcgcctatctgcgggccctcaccggcgccggcatgagcgtggaagcggcctgcgggcagctggagttccgctatgcggccaccgccgaccagttcctgaccatcgccaagctgcgcgcggcacgccgcctgtgggctcgggtcgccgaggcttccggagcccccgccgccgggggccagcggcagcacgccgtcagctcgccggtgatgatgacgcgccgcgacccgtgggtgaacatgctgcgcaccacgctggccacgctgggcgcgggggtgggcggcgcggactccgtgaccgtgctgccgttcgatcacgcgctgggcctgcccgacgcgttcgcgcggcggatcgcccgcaacacctcggcgatcctcatggaggagtcgcacctggcgcgggtcatcgacccggcgggcggctcctggtacgtggagcggctgacggacgaactcgcctcggccgcctgggcgttcttccaggagatcgagcgggcgggcggtctcgccgccgccctgcgctccgggacggtcgcggagcggctcgccgccacctgggccgcgcgcagtgcgaagctggcccgtcgcaaggaaccgatcaccggggtgagcgagttcccgcagccgggcgagcgcccggtggagcgcgagcccgcgcccgacgcgtacgccggggctccgggcggtctgccccgggtgcggcgggacgaggcgttcgaggctc

SEQ ID NO: 4567 - DNA, 597 bp, Unknown
  Kingdom: Bacteria, Phylum: Actinobacteria, Class: Actinobacteria, Order: Streptomycetales, Family: Streptomycetaceae, Genus: Streptomyces
gcctgggcctggtagccgatggtgcgggccagcgactgctgtgccttcgccgcagcggtcgccgccgctgccgcgtaggtcagggcctccttcgaatagccgcgggcgtccgcggcgtgcttggcggcgttcgccgcgtgctggtaggcggccttggcgtcaccctgcgcctggttggcgatgatctgcgcggccgcggcttcctcagccgcgttggccgcgtgggcggctgccacggccttctgctgctcggcgatggtcttcgccgcctggccggacagaaccaccagggaagcggccgagtccttggtgacgtagggcgagccgagctggatggcgtcgttcgcgggagccgcgacctgcgccgccgagttcccggcgtccaccgcggcctgcgcggtgacataggcgaaccccgccgccttggccgcggcggcggtggccttgttggcctcggcccgcgccgcgtccgcctcgttcttggccgtcttcgccttcgcctcggcctcgttggccagcttgaccgacaacgcggcctcggccgaggcgtgttcggaggcatcgatggcgtcggcggccgagctggtcgcggtgcgc

SEQ ID NO: 4568 - DNA, 576 bp, Unknown
  Kingdom: Bacteria, Phylum: Actinobacteria, Class: Actinobacteria, Order: Streptomycetales, Family: Streptomycetaceae, Genus: Streptomyces
tccgtacggcagccggcggcgacgatgggggcgctggcggcgggtctgctcctggaggagaccgggacggcggacgtaccgcacgagcaccggcgggtggtgctgcagccggagctggtggtgcgccgctccagtctcgccgcgcactgagggctgtcggtcagatgtgggagaggagtccgtccagcggtcccggcaggcgtgcgaggtccagcgcttgtgtcagcgctcgcgcatagtgttccttgcggccgccgatggtccccatgaagcgccgcaactgcgcctcgaccgtccgctcccgctgggcgggctgccgttggaagatccggaaggtgcgcaggtctccctggtcgtcgatgacccgctggacgccgtccgtgccgagcgcccggatcagctcgtcctccagatcggcgtggcaggtgaagaagcccagcgcctccaggtcgtcggtgtccggggcggtgccgaagccggtccgctccaggccctggcggaagaagcgctgctccgccgcgtcgcacaggccggcgggccggacgtcgagcccgtcgggccccagcaggcgcaggt

SEQ ID NO: 4569 - DNA, 575 bp, Unknown
  Kingdom: Bacteria, Phylum: Actinobacteria, Class: Actinobacteria, Order: Streptomycetales, Family: Streptomycetaceae, Genus: Streptomyces
gccggagacgaacgcggcggcggccgaggtgccccactcgatgtagtagtgcccgtccgggttggcgaccacgatgtcgtcgccgggggcgctgacggtggcgtaccagcggcgggtggagaacgaggcgtgcgtgccgtactcgtcgacggcggcgaccgcgatcactccggggtaggcggcggggtaggagatccggtcccccttctcgccgccgttgcccgccgacgcgaccaccgggacacccttggacagggcgtactggatggccgcgtcctcgccggggtcggggtgggcggacttgctgtcgtcgcccagggagaggttgatgacgtcggcgccgttgtccgcggcccagcggatgccgtcggcgagggcggtgccgcgggacttgcgggccttggcgcgggccgggtccttggattccaggatgacccggaccggcaggatccgggcctcgggggctatgccgaggatgccgtcggagcgcccggggccgttgccgcgtccggcgatgatgccggccatcgcggtgccgtgcagggcccaggaggagtcgccgcgggcggcgccga

SEQ ID NO: 4570 - DNA, 1795 bp, Unknown
  Kingdom: Bacteria, Phylum: Actinobacteria, Class: Actinobacteria, Order: Streptomycetales, Family: Streptomycetaceae, Genus: Streptomyces
gaccggtcagcagactgccgaccgatcagcaggctgctgaccggtcaggtcgccgggctcgggcaggtcgtcggccggacatcggccccgggcgacatagcggtcggtgaaggcggccacggtgtcgcgcaccgtcccgctcgcccccatccgctccagcgccgggagcgccgccgtgaaacagacggtggccgcggcccgcagctccgggtcggcgagtccctcgcgggcggccgtcgtccagagcggattgcgtggtgcggccggtgagccggccgtctcggccagcggcttcacggcgcggtacacggtctcggcggcctccggatcgtcgaacagggccgtggcgacggcgagcggcaccagccatccgtcgggtccgctctgcgcgtcgatcatgcgcagttcgagatgaccgcgcggccggaccggcgggaacagtgtggtgaggtggtagtcgagatcggcccgcaccggcggccggggcgacccggtacggatccactcgcggaaggtgagcccttccggcacgtcccaggggccctcatcggaccggatgcacagcacggtcgtgtccagcacatgcgcggcccaggcctcgcgcggggtgctcccggagcccggcgcgagggtccggcccggatcgagatcggcccacagcgactgccgggtggagcgccagccggtccggcggccctgctggaacggcgaattcgcgaacgcggcgaccagcaccgcgcccagcaggtgcgcgagctgccagcgtcgtccgtagccgagtggccccggctcctcctcacccgcgtccaggcagacctggaccgacgcggaggtgcacatcatcgcccgcccggccggtcccgcacggtccagagcggcctccatcgcctcgtagcgcggctcccggagcctgcggtgcggcggctgccacggatcgacgccgagtccgaccggtgcgagtcccgccgcgccgagcgtggcgcggaccgccgccagatcggccgcggtggtgtcgacgcactccatcagagagtcggccggctgcgagctgagctccagctgcccacccggctcgaatgtcagggccgcgctcagcggcagcgcacggaccgcctcgacggcgctgtccagccgttcccggccgaccggaaggtcaggtcgttcccggtcgtggatgagccattcgagttccaccccgacggttcgaggggggcccgtcttgaaacatatgccgcgcagtagatcctcggccccgctctcgtcgagcgggacggcgtccgggcgcgagccggttgcgccgggaatgtccaagcccatgagggcctccttctcagctgcgtgcctaccagccaaacccgtacccggagatcgcacaagggtgcccccgggccaggaaaatccggttgcgcccaggccgggttccccgtcagcatgccccgtatgcaccacacgggggagcgccggtgagcgcgcggctgcgcggtatcgcgcgcgggacggaagcggtcgtcgaggccgggagatatcgcaacgcggcaggtcaggacgtgtccatcgaacgggccgtgaccgccgcgctgtccggcacccggctctacgggccggacccggtgcccgtcgccgccctggataccgaccggaccccgcacatcgaggtcaccggcgggccgcggcgaggctgctctcgccggtgacctcgatgtgcggggtccggtcggtatccagggcggcgacgggcaccgggtccggcccgtagagccgggtgccgggcagcgcggcggtcccggcccgttcg

SEQ ID NO: 4571 - DNA, 513 bp, Unknown
  Kingdom: Bacteria, Phylum: Actinobacteria, Class: Actinobacteria, Order: Streptomycetales, Family: Streptomycetaceae, Genus: Streptomyces
ccgcccgggccgacggggactgcctcttccggtcgctcctcgacaccgcgcgcacccggcccgtcccgcccccctgggccgcgcggaacgtcaccggactccgcagcctgctccgcgaccggctcaccggctccgaactgctctccccggacgtcgaggccacccccgacccggtgctcgccgtcgtggacgacctgaggatgaccgccctggccggggtgcggaacccggaggcgcgggagcggatcgggcagcgctgggaccgcgtcgaacaggcggtcgtcaccggcggggacgcacgccgatggcggcagatcctgaaggacagcggctactcccacctcgccgatgtggcccccacccccgccgacgcgcggcggctcggcaccgagggactgatcctcgcggcggccgaactcccggctctgtggtcctcgcccttcgccgacgcgctccccctcgcgctggcgcacaccctcgacatcgagctgcggctcgtccggccggacgagc

SEQ ID NO: 4572 - DNA, 1346 bp, Unknown
  Kingdom: Bacteria, Phylum: Actinobacteria, Class: Actinobacteria, Order: Streptomycetales, Family: Streptomycetaceae, Genus: Streptomyces
ggtacagctcgtgcacctggctcgtcgacagttgttcgcagtcgtccacggtgagcaggggggtggcgtcggaggtcatgcggctccttcctggagcgcgggtcggggggtgggcaggggtccggcggcgcgggcccacgcgagtgcggcgccggtggcggccacctcgctgagcacgcagaccagccggctggcgatgacggccgcggtggcggcggacagcggcatgaccgcgccgaggggtgcgaggaggacgagttcgcgggcgccccagccgtcgggcaggacgaaggcgaggcttccggcgacggtggccagggcgaagccgccgacgcagacgggcagggagagcagcggcggggcgccgaggagcacggcgatcgcccacaggtggagtccggagacggcccaggaggcgcaggcccagccgatggagagccgcagggcccggggggagccctcggcggccccgtcgggccggcgggccagccgcatcgtccaggcgacgaggcggcccacccagccgggccgggccacggcggcggcggcgagcagcacgagcggggcgaagacccaggcgcccgcaccgaacacggccggtgcgacgaggagtccggcggcggccccggtggtcatcccgatgacgaggccgaggccgaaggcggcgatcatccgctcgggagcgatgccgacggccttgccgagctggatgtgggcgaggacgccccagatgcggccggggacgaatttactgatgacgccgatgaagaagatccgggcggtgtcgctggtgcgggccgtggagccgccgtccacgacgaggacccgccaggacagcatcgacaggaccagtccggccgcgttggcgaggagggcggcgatcagcaggagcactcccccgggacggccggcggcctcggccatctccgtaccggcgccgcgcagcgaaccgcccacggcgaagcaggtcgccgcgatgagcacgacagcggcggccgtgcgcagcagccgggcccgccgggaggagcgggcggcggcttcgggcgcaccgggctcggcttccgtccccggcccggcgtcgggtgaacccggcccggcttcgggcgtcccggctcctggtgtccccggcccggcttcgggcggcgcgtccgggccacgacgcgcgttcgcgttcgcctccgcctccgcctctcccggcccggcggactcgcgctcctggtccacgtcggcgctcacggggaggccaccggggccggtcggtcgcggcggccacggacggaggggccgaagcgggggtccatcagccagcgcacgccgcccgtcaccgcgccgaggacgagggccag

SEQ ID NO: 4573 - DNA, 536 bp, Unknown
  Kingdom: Bacteria, Phylum: Actinobacteria, Class: Actinobacteria, Order: Streptomycetales, Family: Streptomycetaceae, Genus: Streptomyces
cgaccaggtactcggcggcgggcgccacgttgcgttcgagctggcgcacctcctcctcggccagttcctccaggacccgccgccaccggcgtacggcgacggcgatccgcccttcgatgtcctcgacgggcccccagcctccggcctcccgcccggcgtcctcgaaccggaacaggctcccggcgggctcgcggcgccactgggtgcggatctgttcgtcggcggcggagaccgagcactggagcagcgccaccaggctgtcgacgagtgcttcgaggagttcctcgggcgagctgtagagcgggtagccgcgccaccgggtccgcgcgtccccggagagcaccgccccgctctggaggcggcggcggatccgggcggcctccttgccgtacgcgtcctggaccaccccggtcagccgtacggaggcggcgtactgggcggcgaccgcggaggccagtccgggcatccgcacgttgagcgactggatggcgccggaggcggtgcgccccaccgcctgctgccgggcggcggggtcc

SEQ ID NO: 4574 - DNA, 991 bp, Unknown
  Kingdom: Bacteria, Phylum: Actinobacteria, Class: Actinobacteria, Order: Streptomycetales, Family: Streptomycetaceae, Genus: Streptomyces
gggtgatcaggacgtcgggccgctccgggcgcggcaggcggttcagctgccgcacagcgtgcacacggcccgggtccggcgctggtagtcgcgggtggcgcccagcagcgccgcgccgaacagtgaccagccgccgtacaccgcgaggatcacccaggagttggcgctccccgcgtcgaagggcagctcgggtccgcccagcaggtggttgacggcggcgaagaccgggatgagtccctggagcaacagcgcggccgacagcccccagccgcagccgaccagcagcagacggggtaccttccggcgggccaggaagggcacccacgacgggtagacgaggccccaggagctgaccagggccagtgagagcactccgccgccgatcagcagcatggtttccatgaccgggaatccctcggggtagtcgtccggacggccgatgccgccacccgcccaccagtaatacttcaccgccgggtagacgaaggccaggccgaaggcggcgtatccgagccagggggaggacttctcccggtcgccggggagcagtccgcaccggtcgcagcccgttccgctgcgccgttggaaggcgagcgtggagcggaccagcagcgcggtggccgcgaaggcgacggcgcgggtcaggaagccgggccagtcgacggtggcgaagtccccggcggggatcccggtcgcccagaagaacgcgcggaacccgtcgaagacgatgccgacggccgcccagagcagcaggacgctcgcggtccagccgagcaccaggacggcggtacgggccgcgccgtgggtgacggagcgggcggcggaggccagcacggcggcgatgccgagagccgcgcccgcccacagggcccaggagggcacgatgcccagggacctgatgtagtcggcggcccccggcaggtggggttcggcggccgcggccgcgaacacgcccagcagggtcagcagcaccggccacggtctgacccgc

SEQ ID NO: 4575 - DNA, 695 bp, Unknown
  Kingdom: Bacteria, Phylum: Actinobacteria, Class: Actinobacteria, Order: Streptomycetales, Family: Streptomycetaceae, Genus: Streptomyces
acctggccgtccagggcggcacggccgccgccgttctcgtggcgtgctcgtcggcggccaccggccgtaccgccgccaccggcacctacctcctgctgctcctcgcctccgagtgcttccgccccgtccgcgacctctcccgcgagtggcacgcgggctatctcggggtgtccgcggccgacccgatcgccggcctgcgcaccgccgaagccgccgtacccgaccggggaaccgtggccgccgactggacgagcgcacccgaaatccgcttcgaggacgtgcacttcacccacccggggagcggaaggcccgccctcgacggcgtcagcttcaccgcagcccccgggcggaccacagcggtcgtcggtccgtccggggcggggaagtcgacactgctgagcctgctgctgcggcaacgggacccggaccggggcagcctcaccgtcgccgggacggccaccgccgcgtacaccctcgcctcactgcgccggggcatcgccgtggtctcgcaggacacctacctcttccacgccacgatcgcggagaacctgcggatcgcccgcccggccgccaccgacgaacaactgcgcgccgccgcccgcaccgccgggatcgaccaggagatcgcccggctgccggacggttacgccaccctcgtgggcgagcgcggcgccacgctctccggcggacagcgc

SEQ ID NO: 4576 - DNA, 616 bp, Unknown
  Kingdom: Bacteria, Phylum: Actinobacteria, Class: Actinobacteria, Order: Streptomycetales, Family: Streptomycetaceae, Genus: Streptomyces
gtttccggccccgtctccgacgccaccggcggggatccgggcgaaagcggcccgaccggtgaagagccgcccgcaatcggggacttcgtcaccctcggcccgctcggcaccgccctgctcgcctacgcgcgaccccgggtgctgctcgtcgacgagctggacaagagcgacatcgacctgcccaacgacctcctgcacgtcctggagaacggcagctacgagatccccgaactcgtccgcagcaaggaggagtcggcgaccgtgttcaccgacgacccgcgcggctcggcgagcgtcgagggcggcagggtcgaatgcgcccaattccccgtcgtggtcatcacgagcaacggcgaacgggagttccccgccgccttccgccgccgctgcctgccactggaaatgctgccgccgggccgcgagcagctgatcggcatcgtcgtcagccacctgcggcaacgcccggagggtgtcgaggcgctggtggacgagttcgagaaccggctgcgcggcggcggcacccagtcgatcgaccagttgctcaacgccgtccagctgacgaccgcgggcggttttcaagccgatgccgacgggcgtaagctcgtcgagatgctcc

SEQ ID NO: 4577 - DNA, 741 bp, Unknown
  Kingdom: Bacteria, Phylum: Actinobacteria, Class: Actinobacteria, Order: Streptomycetales, Family: Streptomycetaceae, Genus: Streptomyces
cgttatggattctcttctcttccgacgccccccgttcgctaggagaaccaccgacatggcagcaacccgccgccccatagccctcgccgcggccgtcgccacggccgccgtcctgggcgcgaccttcgccctgcccgccctcgccgccgacggctcctcggaggccgcgtccgccgccgctccgaagctggagctggtggacggcacgctggactggggcatcaaggagtccttccgcaagtacatcgcgggccccgtcgcggggggcaggatcaccgtcacggacggcgccgagcaggccgccgccaacggggtgttcaccttcaccggcggcaagggctcgtacgacacctcgacccacgcctccgacaccgcgttcaagggcggcgtccggttcgagggccaccacggactcctcgacgtccagctcagcgacgtcaaggtcacctcggggcgcgagaccggcaccgtcaccgccgacttcacgagcaagaagatggacggcaccgtcgtcaccaagaacgacgccccgatcgccgatctggacatgaccaaggccaagcggggcggcggcgcgggcggcgcgatggtcttctccgacattccggccaagctgaccgccgacggctccgaggccttcgccggcttctacgagaagggtgccgagctcgacccggcgacgctctccgtcaagcaggcgaacgtaccccccaccaagccgccgaccacgccccccgtgac

SEQ ID NO: 4578 - DNA, 853 bp, Unknown
  Kingdom: Bacteria, Phylum: Actinobacteria, Class: Actinobacteria, Order: Streptomycetales, Family: Streptomycetaceae, Genus: Streptomyces
  misc_feature (351)..(352): n is a, c, g, or t
tcggcgtgcatggcgacggcccggccgagcttcgctccccaccccttgaactgtttgcgcacttcccagttgaggttgacgcgcagcgcgccggaggtgccgccctgtttggcgagcgagacggacggcgcgctcttcgtcagcgtgaccttggtcagccgtacgggcgccgcggcgggcggggcccgtacggctgaccaaggtcacgctgacgaagagcgcgccgtccgtctcgctcgccaaacagggcggcacctccggcgcgctgcgcgtcaacctcaactgggaagtgcgcaaacagttcaaggggtggggagcgaagctcggccgggccgtcgccatgcacgccgnncgacggccggaagggagtcgtgcagtcgctcgggaacgcgttcggctcactgaccaggccgcccttcatccatctcgacggcgacgaccgcaccggcgcgctctccaccggcgagaacatgaccatcaacctcgaccacaaggacctgctgcggcgcgtactgatcttcgtcaccatctacgaaggcgcccggagcttcgccgatctccacgccacggtcacgctccagccgcagaacggcgcggccatcgacttctccctcgacgagtgcaccgtgccctccaccgtctgcgccctggccctgatcaccaacaccggcggcgacctcaccgtgcagcgcgaggcccgctacctcgtcccggaccggggtgtgagcccgcagcgcaccatcgacgccgcctacggctggggcatgaactggacgcccggccgcaagtgacccgcccccagggagtctcccgccacgtccgcccggaccggccgcccgtcctcccgcggcgt

SEQ ID NO: 4579 - DNA, 673 bp, Unknown
  Kingdom: Bacteria, Phylum: Actinobacteria, Class: Actinobacteria, Order: Streptomycetales, Family: Streptomycetaceae, Genus: Streptomyces
ggcagccattaccccgcgtaccaccccggcagcgccgaccccgaactgaaccggcccgtccacgagcggtatccgcagatccgtcccaccagcggatacggggacccccgcgtccggcacaccggccccggacccggagcgggcaccgaccaggaccccgagcgctcctcgaaactgaccgcccggctcaccctggccatgaccgtcgtcatcggccagctctggggactgacggtcctgatcgacgagtggatggagggcagcaccggcaccgcctggtggggggccggcttcctctgcctgtcgttcctcgtcgtgctcggcctgtggctcgtcgacccgaaggaccgctgaagcccgccgcccagccgcacggcggctcacagctcgtggtgagccgccgtaccctggagacatgagcgccgcccccgcccccagcccgcgcgatgcgaagcagcagcagccacaggagcacaaggaaccgaagcccaagccggttctggtcttcgacgatccgctggaccggcagtccgcggacgatacggaccaggggtggggcgagcggcctccctccggcggcagcgccgcggacctcgcgcgcttcctggacgagaagcccccccaccacatctgagcaggagcccggagggctaccggtccgcgcgcggaccgg

SEQ ID NO: 4580 - DNA, 529 bp, Unknown
  Kingdom: Bacteria, Phylum: Actinobacteria, Class: Actinobacteria, Order: Streptomycetales, Family: Streptomycetaceae, Genus: Streptomyces
tgtcgttcagaactccccggatcggtcggtgcgaatacgttcgaggagcagcagggacaccgcgcacaccagcatcagaatcgtgctgagggccatcgcctgcccgtagttgagctccccggaccggcccagcagccgggcgacggcgaccggcagcgtcggattgtcgggccgcgcgatgaagaccgtcgcgccgaactccccgagggagacggcgaaggcgaagcccgcagcgaccagcaccgcccgccgcaccagcggcagatcgacctcccgccaggcccgcagcggcgaggcccccagcacggcggcggcctcccgcagccggtcgtcgaccgcgcgcagcacgggcagcatggtccgtacgacgaaggggacgccgaccagggcctgtgccagggggaccaggatccaggaggtgcgcaggtcgagcggcggctcgtccagggtgatcaggaagccgaagccgacagtgacggcggacaccccgagcggcagcatcagcagcgcgtcgaagccgcggaccagc

SEQ ID NO: 4581 - DNA, 909 bp, Unknown
  Kingdom: Bacteria, Phylum: Actinobacteria, Class: Actinobacteria, Order: Streptomycetales, Family: Streptomycetaceae, Genus: Streptomyces
cagggcggccgaccgccgctccagccgttcccgtacgcggcccaccgcaccggtggcgcgcagggtcggcatcccctggagtgcctctaggtagtcggcggcgagggcttcgtaggagtcccagtgctccttgccgcgccgcgcgagcagccggtcccaccagcgcggcccgaagagggcgagcagcagggcggggccgagggcgagagccgcgtacggctcgacgagggcgacggcgacgagcagcagcggcggaacggcgcaggtgatgagcgcttggggcagatagcgcgagacgtacgcgtcgacgccctcgactccgtccaccagcgtggcgcgcacggctccggcgcgcgcaccggtgaccgcggtggggccgagggcgccgagccgctccagcagggtgtcgcgaagcctgatccgtacggtggctccggccgtgacggcggtcaggcgctgggcgcggccgaggccggcacggaccaggacgacggcgatgacggctgtgagcagcggggcgagggcggccgtctccccccgggcgatccgggcgagcacgagggcgagaaggacggcctgggcgaggtgggtggcggtgaccgccgcgagcagtgcggtggcgaggccgagggggcggcgcgcggtgttcgcggcgcgcaggagttcggggtggagcatcatgggcgttcttcctcgccgggcggagccgccggggcggcgggatgcgtggtcgctgtggcaggtggcatgggggcagttgtcgttggggcaggtggcgtttcggccgtcggtgggtgtcggacgaagcccgggtcgaccgggcctgacggtggcggtgctcccaccgccaggccgtgcacgatccagtcccgtccgggggcctcgccgagcgccgcgcccaggtccgcc

SEQ ID NO: 4582 - DNA, 601 bp, Unknown
  Kingdom: Bacteria, Phylum: Actinobacteria, Class: Actinobacteria, Order: Streptomycetales, Family: Streptomycetaceae, Genus: Streptomyces
ctggagctccttcgccgaggcgccctcggcgaaggagctccaggagacgctcgggatgtggacgatcaccgtgcagagcgcccggctgaccacggtggtcgacgcgtcgggttccatggcgacgctggtcccgggccggggccagtcccggatggacgtcaccaaggagtcgctgatccaggcgctgagccagttcaccccgaacgacgagatcgggctgtgggagttcgccaccacactggacggcgacaaggactaccggcggctcatgccgacgaagcggctcggcgacccggtcaagggcggcgggacccaccgggagaagctcacggccgcgttcgcggggctgcggccggtacccggcggcgcgaccgggctctacgacacgacgctggcctcgtacaaggaagcccggtcgacgtatcggaagggcaagttcaacgccctggtgatcctcaccgacggctccaaccaggacgagcggagcatctcgcggagcgggctcatcgcggagctcaaggagctccgcgacccggagcgtcccgtcccggtcatcgcgatcgcggtgggcccggacgcggaccgcgacgaggtcgccgag

SEQ ID NO: 4583 - DNA, 858 bp, Unknown
  Kingdom: Bacteria, Phylum: Actinobacteria, Class: Actinobacteria, Order: Streptomycetales, Family: Streptomycetaceae, Genus: Streptomyces
cctccggggcgaacgccgtcgccgccgcccggacggtgatccgcagccgcccgccgtccggaccggccgccaggaacacatcggtaccggacggcggcggtgtgtacgcgctgtcgccgccctcccggctgatcgtcagcgtcctgccgctctccggacccagggcggagaagtccagataggtgaagaagaactgcgcagccatgggcagcccgttggacaaccgaggcaggggcccctcgtatgtccgcgcctcggcggcctcggcggcgacgcgccgcagatcgtcctcgaaacccgtgctgtcggagcggccggacgccggacccgccggacgcaggggaaccgctgtggcgaagggaccgaacacccggtgtgcgtcgggcagggagtggtcccggccgctcaccgcgagaccgagcaccagatccgcccggcccgtggcggccacgagagcccggtagtaggcggtgagcaccggggcgtggagagtggatccggtgcgcgcggcgagccggcgcagcgcctccacccggtcggcgtcgaccgtgaacccgtgggtgtggaagagcgggtcggcgccggtgccgggaggcgtgccggtggcgggcgcagcggcggcgagcacgggcggccggtagggcgcactcagccgcgcccaccgttcctcgtcggccggggcgcccggcagcggtgacgcggccgctatgacggaggccgtcccggcggcggtccggcgggacgccgccgggggcgcggtggccgtgtccgcgcgctccgccagctggagggcgtggtcgcggaaggtgctgcgcagggggaccggcgccggttcctcaccgcgggacagggcgtcgt

SEQ ID NO: 4584 - DNA, 1117 bp, Unknown
  Kingdom: Bacteria, Phylum: Actinobacteria, Class: Actinobacteria, Order: Streptomycetales, Family: Streptomycetaceae, Genus: Streptomyces
gacgtcggcggcggcgtcgatgcgggcggcggggtggccgtcgcggtctgcggcggggtggccgtcgcgacgggtgggacgccgagggcatcggcgaggggcagcagcacgttcgcgccggggaacgccgtgttcgccggcgcgttcgggccctcgacgtactccggtccgccgagcgggcggacctgcaccggggcgccgggcccctcccgggtcagctcgaacgcgccgcgctccgggagtcccgtcgcgtcggtcccggtcggcgggccgagcacgacggcccggtccgcacccgcgctgtccagcagcgcggctgcctcgggagacccgtcgaccagcgacggaggggtttccgagacgatcaccgtcagcggcggattctccgtacgggagccgggaccggtgtcggtgccggcatccgtgtcggtacggtccgcggtgggcgggccggtgactgcgtcgccgggcgtcccacgcgtcgcagggctgtcgccgatcgcgggcgcgtcccccgtggtgccgtcggtgtcgacctcggccgggccgggcgtgccgttcgggccgggagcggtctccgtaccgttcgcaccggtctcgcggaccgtgtccggacccgtcggcgcgccgcttcccggtgggggcgtcggcgtcccctcccccgcaacgggtgggtccacggtcaccggtgtgccgaagctctccagcgcccggcgtacctcgtcggcgtcgatctccgcggccggcccgttgccggtgggcaccacccgtatctcggggtgctgcgacaggttgccgtacaggccgtcgcgtacgccgatctcggccgggccgggcggctgttcgccgcggatggcggcaaggtcgcggagcgcctgctcgcgcagctcgggcggtccctggtggacctgctgccacagcgcgtcctccgcggcggtcaccggtagcgggccaggggtgtacgaaggcgggtccaccgggacgtacgcgggcgggtcctgcggcgtgtagggcggcgggctctccgccaggtcgggccgcggggaggggctgccggtgtactcgtccaggtcggtggtctccggggagccggggggccgaggcgctccgggcgtgg

SEQ ID NO: 4585 - DNA, 524 bp, Unknown
  Kingdom: Bacteria, Phylum: Actinobacteria, Class: Actinobacteria, Order: Streptomycetales, Family: Streptomycetaceae, Genus: Streptomyces
gcagggaacggcaccggagcgcacggcaccagggggcacggcgcaggcagggtcggtgcgggcgggaacgaggaatccgctggtgatcgtcgcgctggccctggcggtctgcgcggccggagcggcgggctggggcggctggctgcgctacgaggccacgcacgacgacgcggcgtccttcgcgcagacgcgggacgacgcgctggcggcgggcgaacaggcggtgcagaacatgaacaccctggaccaccggtcgctggagaagggtctcgacagctgggagcagtccaccaccggcgatctgcaccgccaactcgtcgacggacgtgaatcgttcgccgagcagatcgccgaggcgaagacggtgagcacggcagaggtcctctccggcgcggtcaccgagctggaccaacgggcgggccgagcaggggtgatggtggcgttgcgggtcaccgtgtccgcgccgaagggtgaaccggcggtgaaggagagccggttgctcggaagtctcacccgtacggccg

SEQ ID NO: 4586 - DNA, 748 bp, Unknown
  Kingdom: Bacteria, Phylum: Actinobacteria, Class: Actinobacteria, Order: Streptomycetales, Family: Streptomycetaceae, Genus: Streptomyces
gccgcgacacgcgccggggtgcgcggcgccgccctcgtcgccgtcggcggctacggccgcggcgagctctccccgcgcagcgacctcgacctgctcctcctgcacgacggcagcgccgacgcggcggccctcgccgccctcgccgactccatctggtacccggtctgggacctgggcctggccctcgaccactccgtacgcacccccggcgaagccaggaagaccgcgggcgaggacctcaaggtccagctcggcctgctggactcccggcccgtcgccggcgatctcggcctcgtcgcctccctgcgcaccgcgatcctcgccgactggcgcaaccaggcccccaaacgcctccccgccctccacgagctctgccgggaacgcgcggaacggatgggcgagctccagttcctcctggaacccgacctcaaggaggcccgcggcggcctccgcgacgccaccgccctgcgcgccgtggccgcgtcctgggtcgccgacgccccccgcgaaggcctcgccgaggcccgccgcaccctcctggacacccgcgacgccctgcacctcaccaccgggcgcgcaggacccggttgacctcgcgccaggtgacgtcggtggcgtacgagacggtgcgggcggcctcgtagaccttgcgcagcagggcgtcggcgtcgaggaggccgagggcctgggcgacctggtcctgttcctggagggcgaggcggtcggtggcgcgcccggtggtgaggtg

SEQ ID NO: 4587 - DNA, 544 bp, Unknown
  Kingdom: Bacteria, Phylum: Actinobacteria, Class: Actinobacteria, Order: Streptomycetales, Family: Streptomycetaceae, Genus: Streptomyces
  misc_feature (169)..(262): n is a, c, g, or t
cgctccggccggcgcgggggcgggacgcggtgacgcggggttcgagccgtacgacttcctgccgaccgacccgtggcacgagaaagacttcagggaggcccgttgggcctccctgaagcgggggtccggcggactcatggccgacttccccgccgatcccgccgatccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcgggccggcccgcgccggatccggaccgcccgggagctactccttgacgccgaagaacggctccagcggcttcggcagctggtcgttgcaggcgagctggccggtcttggtcagggcgtcgttcacacaggtgtagtagtcgcggtagacgagctgcacggtgaacgtggtcgccacgatgagcagcgccagcagggcggtcaccaggccgctcaccgccgccgtggtctgctgcctgctgctgacgttctgcggcgcggcgggcgggggcgcggcgggag

SEQ ID NO: 4588 - DNA, 749 bp, Unknown
  Kingdom: Bacteria, Phylum: Actinobacteria, Class: Actinobacteria, Order: Streptomycetales, Family: Streptomycetaceae, Genus: Streptomyces
gacggcaccagcaaggacaaggtgctcgtcgtcggcatggacgggctgcgccacgacgtcatcgccgccgccaaggccccgcacctcaagtcgatgatggcgaacgggacgtacggcacctcgctgctctacgccaacccgatggccgccacctcttccggccccggctggtcgaccatctccaccggcgtctggcccgacaagcacggcgtcagggagaactccttcgccgggaagaactacgggaagtaccccggcttcctcgcccgcctcgcccaggtccgcccccagctctccacctacgccgccgtcgactggaagcccctggacgtccagggcacggtcaccccgggtgccgacgccaagctcgtcctcgacggcgacgccgacggctacaccggccacgacgccaccatcgccgccgagaccgagtcggtcctccggaaccagaacccggacgtcctgttcgtctacttcggccagaccgacatcgtcggccacaactccggtgccgccagtgcccggtaccgcgaggcgatcgacgtccaggacggctacctcggccgcctcctgaccgcgatcagggcgcgtccctcgtacgccaccgagcggtggaccgtcatcgtcaccaccgaccacggccacaccgactccggcggccacggcggcagcgcgatcgaggagcggcgcaccttcgtcctcgcccagggccccggcatcgcggccggcgcccgccccgccgacacccg

SEQ ID NO: 4589 - DNA, 700 bp, Unknown
  Kingdom: Bacteria, Phylum: Actinobacteria, Class: Actinobacteria, Order: Streptomycetales, Family: Streptomycetaceae, Genus: Streptomyces
gctcccagcggccacgccactcgggcgtccggggacggacgagcgcggcggcggcacggtggaacgcggccagcggctccgggtcgccgccctccacggcttcgcgcaggacgaggaacccctccacggcgaggtcgcgccgggcccgcgccgcccgctccagcacggcctcctcggcgtccccggggagcgtcgccgccgcgcggtagacgtccgggtccgcgaggcagcggggcggcagggtgagcacggcgtcgcctgcctcgggcagcccgctgttctgcatgagcacgatgacgcgcagaccgtcctcgttgaccaggcggtgcacggcgcccggggtgaaccacacgagcgcgccgggcgtcagcggggtctcctggaatccggaggccgtcagggtctgcacggaaccgctgccgccgaccacgacgtacccctccgagcaggtcaggtgcagatgaggggtacccccgcgcagcccgtcggcggcgggccagtcgtagacgctcaggtgcgagacggcgacggcgccgggcagtccttcgaaggtcaccacagggactcctgggtctcggcggcacgggccgcacggccacgcgcgggcgcaccgcaccggtcgtcccgcaagcgctttctacggcagctgaacgctagggccgccgccggacgccggtcaagggcgcggcaggcgccgcac

SEQ ID NO: 4590 - DNA, 623 bp, Unknown
  Kingdom: Bacteria, Phylum: Actinobacteria, Class: Actinobacteria, Order: Streptomycetales, Family: Streptomycetaceae, Genus: Streptomyces
ccggccgccgcttcccgcaggcggacgggctggcgctggcgatggtggtcgccgcggtcctctcgctgcccctgggcgtcatcgagtccggcgcgaagctcgcggtcccgtccaccgtggcgctcggcgcggcggtggcgctcctcagctcggtccttccgtacaccctggagctgatggcgctgcgccggctgcccgcgcccacgttcgccgtgatgatgagcctggagccggccatcgccgccggtgcgggcttcctgatcctggaccaggccctctcggcgacggacgccctcgccatcgccctcgtcatcggggccagcgtcggcgcggtgcgcagccggacgggccgacgccgcgaggggtgagccgcggcgaagcgacgcgtccgggcgtcgtgccggggctccaggaccggcttctcggcgtcgaaccggacggtcaccgtgcggggttcggcagtcatcgacggaggctgacagcgcgccacggccgacggctgccggcatgccctcgtccgggcggggccggacctcacgggtcgagcggcgggcgggggtggccggccggaaaatcatgcaagcgtgcttgattgtttcccggcccactgccatgctcctggg

SEQ ID NO: 4591 - DNA, 1475 bp, Unknown
  Kingdom: Bacteria, Phylum: Actinobacteria, Class: Actinobacteria, Order: Streptomycetales, Family: Streptomycetaceae, Genus: Streptomyces
attcaggttcccgcttacgctttgcctacacgtagagggcgtcaataggcctccccgggcccggaaaagggggggagggagggacccgcgatgaccgcagcgttcgtcgagaacggccaggcttcgcatgggcgcgcgtgggactacctgctgcagacatggcgtgaactggacgtgcccgagggatggcgcgccgagatcgacgaggggcagatcgtcttggtaccaccgccgcacgcgcaccaccacggcatcgccgccaaggtgcagcgaaggctctacgcgacgctgcccgaggatctggagatctaccagaccctcggcgtccacgtcgccccgctcggcaagctgtacgtccccgatctggtcgtcatgccgaccgagctgatcgcggcggccgatccggaggtcagcgacccgatggacgcctcggaggccttgctcgtcgtcgagatcacgtcgcgggggaacgcgcgggaggaccgctcgaagaagtaccgcgcgtatgcccgcgcgggagtcccgatgtacctgctgatcgaccggttcgacacccgggggccgatggccacgctgttcacggaacggaacgaggacggcacgtacaagcacacggacgcggtgccgttcggcaagccgctggctctgccgtccccgttcgacgtgcagctgatgacggtggagttcccggggcccgccgtctagaaggtctccgccgacgggcgggtgaccaccttgatgttgaaggtgtgggaccccaccccgcccgcgatccccatgaagaggaacgcgaagtgctcctggccgcgcgccgtggtgatgccgccgatgtcgagctgggaggactccggccagccgaggtccgtgagcaggcggccggtggtgcgcttggcctcggcgtcgtcgccggagaggaagaccgtgcccggctcggtgagttcgccgggggcggtcatggtggtggagtccatcgtgcagagcgtcttgacgacgggagtcagcgggaacgcctcctggatcagttcgcccaggctgctgttggggtgggtgagcgcgctgaagtcgtcggagaggccgacgccgacgtcgatcagcagcgtaccggccagcgccggggctccgatggagcgcagcagatcgacggagacgccgccaggagtggcattgaccagcacttccgcgtgcgcggccgtctcgtccagaccggcgaccggcagtccgaggccggtgcgttctccgggccgacgggatccgaggaggacgtcgtgtcctgcggcgcgccagccgtgggccagggcgcgggcgacatttccggtaccgagaagtcctatacgcatgggatcgacgctagccagccgggccctggggcgtatcgggccggagaccggggcggggcggtacctgaggcgtagtccgcaggacaccccccggtcctccccgccgggacgggcggggaggaccggggggtgtcctgc

SEQ ID NO: 4592 - DNA, 1029 bp, Unknown
  Kingdom: Bacteria, Phylum: Actinobacteria, Class: Actinobacteria, Order: Streptomycetales, Family: Streptomycetaceae, Genus: Streptomyces
ctcttcggtacggcggccttcgcaccgctgccgttcaccctggcccggcccggagtgaccgcggacgtgctcggcaaggacgacgggcggccggtgatcaccatcaccggcgccgagacccggcccaccgacgggcagctgaggatgacgacgatcctcgccaccgggccgaaggcggacgtccgtatcggcgcggtgctcgacggctggttccgcagcgaccgggcggtcatgccgcgcgactccgtctaccccaccggcggctccgagaaggagatcgagcagcacaacctcgacgacatgaagcagtcgcagaacgtcgccgtcgacgccgccctgaactacctggaccgcgagcccggttcgatgcgggtcgaggtggacctcggcgacatcggcggcccgagcgccggcctcttcctctccctcggcatcatcgacaagctcgacggaaacggctccggcggcgacctcaccggtggccgcaccatcgccggtacggggacgatcagcgcggacggcaaggtgggcgcggtcggcggggtgtcgatgaagacccaggccgcccaccgcgacggggcgagcgtcttcctcgtaccgaaggccgagtgcgctcaggccgaggccgagcggccggacgggctgcggatcgtgcccgtctccacgctgaaggacgcggtcggctcgctcaaggccctggagacgggcgggaaggtgccgggctgctgacccgctgctccacggagggcaccggcggacccgccgtctctgcggtctccgcggcgtccgtggtctcggtggtctccgaggtctcccgggtttccgcctccggcgtgtcgtccagcgtccgccaggacgggaacaccagcgggctcagcgtggccaggaagtagaccccgcccatcagcagcagcgcccccgtcaccccggcgccctccaccagcagcccggccgcgagcccgcccagcggcatcgcgaactcgcagcccgccgtcagcgcccccgacacccggctgcgcagccggtccg

SEQ ID NO: 4593 - DNA, 622 bp, Unknown
  Kingdom: Bacteria, Phylum: Actinobacteria, Class: Actinobacteria, Order: Streptomycetales, Family: Streptomycetaceae, Genus: Streptomyces
gtgcgcaccgcgtcatcgacgagctcagggtgtgcgcggcgtcgaggcgacgacgatcgacgcggccgtgcgccgcgcacaccctgagctcgtcgatgacgcggtgcgcaccgtgatcctccgcggtggctgcgccgcacttgaagagcatggctcgtggatgtcggatgtcaccgagttcgagcgggcgagccgacggcgcgacgccgagtagtccatcctgtccagcgatcggtggtcggcgcgcaccgggccgccggtgcggcccgaccgcgccggcggcccggtgcggtcgggcgggtcgaaacccttcccggcccgtcgtacgggcgatccgccggtacgtacccggcggcggttcctaccccctgaaggcctccagcagccgcagccacacctcgctgatcgtcgggtacgccgggaccgcgtgccacaggcgggcgatggggacctcccccgcgaccgcgatcgtcgccgagtgcaggagttccccgatgcccgggccgacgaaggtgacgccgagcaggatctcgcggtccaggtccacgatcatccgggcgcggccccggtagccgtcggcgtagaggccggatcccgcgaccgcggcgaggtcgtggtcgac

SEQ ID NO: 4594 - DNA, 822 bp, Unknown
  Kingdom: Bacteria, Phylum: Actinobacteria, Class: Actinobacteria, Order: Streptomycetales, Family: Streptomycetaceae, Genus: Streptomyces
gccccggcagcccgaagcgcggcagccggggccgcgcgaggggcaccagccgcaggaacacgggcagctgggtcaggatcatcagcacgctgccggccgcgacccccaccgccgcggcccgcacgccccacaccgcgtgcagggccagcgtcatcccgatgatgccgaggttgtacgcgacatagaccccggcgggcggcaggaagctgcggtgcgcgcgcagcgcggcgctgaagtacccggtgatcccgaaggtgaggacggtgaccgaggtcagccgggtgcagtccaccgcgagccgcggatcggcgaggcccggggcgagcacgcccacgacccacggcgcccccgcgaccagcagcgccgcgccgccggagagcaggaggaacaggcgggggagcgtcgtcgccaccagatcccgtacggggtcggaaccgggagcttctccggccgccgcccgccgggtcagggcgaggctgaacgcggggaccaggaggagtgccatcccgtcctcgatcagcagcgtggctgccatctcgggcacggtccaggcgatcaggaaggcgtcgctcgcgtcgctcgccccgaagtaccgggcgatggcctggtcccgcaccagaccgaggagggcccccagcacggtcaacaccgccgtggccgccgccgcgcgggcgaggaaggattcgagccggggcgcctcaccgctcgacgtccccggcgcgacaccgggggagagaaggccttcgggccccggcccgggggtcgggagcagcggcggggcggccgccacggccgccgggcgcgccccggtctccgtccccg

SEQ ID NO: 4595 - DNA, 568 bp, Unknown
  Kingdom: Bacteria, Phylum: Actinobacteria, Class: Actinobacteria, Order: Streptomycetales, Family: Streptomycetaceae, Genus: Streptomyces
gtgcagggcacggacctggtgcgcgaggcgtgcatgcgccgacatgtggccgaggccctggcgagcgggcggcggcccgccgtggtggtgggagccttccacaccccggcgctgctgccgtccgccgccgcggacgccgacggccccaccccggaaacaccggaaacaccgaagacaccggaagtaccggaggcacccggagcacccgaagcgccggaccgggccgccgcgtccgggacgggcgcggacggccaggtgcacgccgccgcagggaccgccacctgcacaatctccctggtgccgtacacgtacccgctgctcgactcacgctccggctacccggccggcatccgggacccggagtggcagcacaccgtcctggacgccgccggggacccggcggcgttgcacgaggcgctcatccgtaccgcggtccgcctctgcgccgccctgcgcgaagagggccacccctacggcccggcggacggccgggaggtcgtccgggtggccggtgacctggcccgcctgcgcggcctgcccgccgccggccgcggcgaactcctggaag

SEQ ID NO: 4596 - DNA, 589 bp, Unknown
  Kingdom: Bacteria, Phylum: Actinobacteria, Class: Actinobacteria, Order: Streptomycetales, Family: Streptomycetaceae, Genus: Streptomyces
gcgccgacagtgcgccggtctcgtcgtcgggcccgtccgccgcggccgccgatatcagcgcgggagccagccgcgcgggtgcggaccgggagagctcgcacgccgtcgtgaccacccataccgcctcggtgcgggcttcgggatcagcgctgcgcagcgcggcgtcgaggagagcgaacaccgcctcgcggtccgcctcggtgtcccggtccagcagggtcaggcagatgtcgtgcaggggttcgttccgggagtggtcgtaccggtcggcggcgaggcggtccaggggaagcaggtccagcaccgctgcgtggtggtcgcgggtccagggaagcccgatgtccgcgcaggccatgacggcggcgatccgcagctccggcgggctgtccgggccgaccgctccggccgccgcggaggcgctgccctcggggtccaactccaccagggatgtgagcagttcggcacggacgaggggatccgtctcgaccgccgcccggtcgcggagggccggcacggcgagggcggctccggccgttcccgtccaccctgcggcccaggccgccgcctggcgtacggcacggtcctcatg

SEQ ID NO: 4597 - DNA, 1210 bp, Unknown
  Kingdom: Bacteria, Phylum: Actinobacteria, Class: Actinobacteria, Order: Streptomycetales, Family: Streptomycetaceae, Genus: Streptomyces
cagtgggagcccggcaccgaccacggctaccacgcccagacctacagctggctgatcggcgaactggtccgccgtgccaccggccgcaccatcggccgctggatcgccgaggagatcgcccgcccgctcggcctcgacttctggttcggacttcctgccgacgaggcccaccgcatcggccgcatcggtcccgtggagcctccggctcccaccgcagcctcgggagccctgcgcgtacgcgccaaacgctccgtcgtcgaggcctaccgcgacccggactccctcacccgcagggcgttcggcgcgatcgacccgttccccgacgagaacgaccccgcctaccgcgcggccgaacttcccgcctcgggcggcatcgcgaccgcccggggtctggcccgctgctacgccgcgatgatcgggccggtcgacggccaccgccgcctgttcgcacccgccaccctcaccctggcccgcaccgaggagtcggcgggccccgaccgggtcctggtcgtcaacacccgcttcggcctcgggtacatgctgcacggcccggccgcccccctcctcggacccggctccttcggccaccccggacgcggcggctccctcggcttcgccgaccccgagtccggcatcgcgctggggtatgtcaccaacggactccagaagggagtcaccgccgacccccgtgcccaggccctggtcagggcagtacggtcggcgctatgacaccagcatccgcccggatcccggcccgcttcgccggatacagcgtcctgatcaccgccgccggccagggcatcggcgcggcaacggcccgccgcctggcggcggaaggcgcctccgtcctcgtcaccgacctggacgcgaagcgcgccgcccacacggcggcggcgatacgcgaggcgggcggcgccgccgaatccctcgtctgcgacgtggccgaccggacggcggtcgaggcggccgtcgcccacgcggtcgccgccttcggccggctcgacgtcctggtcaacaacgcctacgcggcgggccaggacaccccgctcttcgaggacgagacggacgaggtctgggaacgcgacctggacatcaccctctccggtccgttccgctgcgcgcgcgccgccctgccgcacctggtcgcctcgggacggggtgcgatcgtcaccatcggctcggtcaacggcgaacaggacttcggcggcca

SEQ ID NO: 4598 - DNA, 583 bp, Unknown
  Kingdom: Bacteria, Phylum: Actinobacteria, Class: Actinobacteria, Order: Streptomycetales, Family: Streptomycetaceae, Genus: Streptomyces
gtccggcggcccggtcgccgccgggtgcggtggcccgggcccgctcgtgcagcgcctgctgggcggcgagccggtcgcgggccgcgaacagggcgcgggacaacgcgcgggcggtgtgccgctcctcgacggtcaggaagcggttgcggctggagagcgcgaggccgtccgcgtcccggacggtgggcacgccggtgatccggacgccgaagttcaggtcgcggaccatgcggcggatcagggcgagctgctgggcgtccttctgcccgtagaacgcctcgtcggggcgggtgaggtggaggagcttggcgacgacggtgagcatcccgtcgaagtgcccggggcgggacgcgccttcgaggcgctcgcccatgggacctgcggtgatccggacctgaggctctccgcccggatagacctcgtccgcggcgggggcgaacaccgcgtcggcccccgccgccgcggcgatctccaggtcggcgtccagggtgcgcggatagcggtccaggtcggcggcctcgccgaactggagcggattcacgaagacggtgaccacgacctggccgtccgcaccggccgccgc

SEQ ID NO: 4599 - DNA, 751 bp, Unknown
  Kingdom: Bacteria, Phylum: Actinobacteria, Class: Actinobacteria, Order: Streptomycetales, Family: Streptomycetaceae, Genus: Streptomyces
gcgaccgagggggcgtacgacctggtcagcctcgacccgcgcggggtcggcggctccacccgggcgaactgcgggatccccgaggcggaccggcagttggtgacgctgcgctcctggcccgcggcggacggctcgatcacggagaacatcgaccgcgcccgccgcaccgcggagtcgtgcgcccgcgacggcggcccggagctgcggtccttcaccacgcggaacgaggtccgtgacatcgaccggctgcgcgccgccctgggcgagcggaaggtgtccgtctggggctcctcgtacggcagttacgtcggggccgtttacgcgcaggagcacccgcgccgcgtcgaccggctggtcctggacagcaccggcgacccggacccggcgcgggtggcgtacggctggctgtccaacatggcgccgggcgccgcggaccgcttccccgacttcgcggcctgggcggcggaccccgcccgggacgccgaagggctccggctggcccggcgcgccgagggcgtgaagcctctgttcctcgcactggccggggagctggaccgtacgccgaaggagtcggacgtgcccggcgtcccgctgaccgggaaccggctgcggcaggctctccagctcgccctgtacagcgactccgcgttcgccccgctggcccggctgatccggtcggcgcaggacccggaggcccgtccggcgctgccccgggagctcgcgggcgcgctgccggacgggcctccgggtc

SEQ ID NO: 4600 - DNA, 599 bp, Unknown
  Kingdom: Bacteria, Phylum: Actinobacteria, Class: Actinobacteria, Order: Streptomycetales, Family: Streptomycetaceae, Genus: Streptomyces
ggacccacgccgacggcgtgctgaccggccgggccggacccggccaggacctgttcgtccccccgtccggcgactccctcgacccggactccgacgccccgcgcctgctcggagcggtgggggaggaggacttccggctggtggcccgggtacgcccgggtctgctgtcggccggcgacgcgggcgcgctgtacctgcacgtcggggaccgcgagtgggccaagctctgcctggagcactccgcggacctcccgaccgtctgcaccgtcgtcacccggggccacagcgacgacgcgaacgccttcgtggtggaggagggtgtgtgctggctccgtctgagccgcacgggcagcgcctacgcgttccacgcctccgccgacggcgagacgtggaccttcgtccgcgtcttcaccctcggcacggagaaggagcgggccgccgcccgcgccggcttcctggtgcagtcgcccaccggcgagggctgcggcgcggtcttcgaccacatcgcgttcctgcccgggggagtggagaacctgcgcgacgggcggtgaaggccggcgcggcggtgagggggacgcggcggtgacgggggacgaggc

SEQ ID NO: 4601 - DNA, 638 bp, Unknown
  Kingdom: Bacteria, Phylum: Actinobacteria, Class: Actinobacteria, Order: Streptomycetales, Family: Streptomycetaceae, Genus: Streptomyces
tcgacttcgggatcgcccgcgccgccgacgccaccgccctgaccgccaccggactcgtcgtcggcacgcccggcttcctcccgcccgagcaggcgtcggggaataccgcggggcccgccggggacgtcttctcgctcggctgcctcctggcgtacgcggccaccggccggccgcccttcggcggcggcgcggtcgacgccgtcctctaccgcaccgtgcacgacgcacccgacctcgacgggatcgacgatgcccacctgcgcgcgctcctggaccggtgcctcgccaaggaacccggcgaccgtccggccgccgccggcctcgacaccctgatcgccgaggacgtacctgccggggccaccgccgactggctgcccgaggacgtcgtccggatcatcgcggaccggtccgcagccctgctggccctgcccgacatcgacgccaccgtcaccgaggagcccggcccgcaggaacccgcccccggccgacggcggttcctgctcttcgcggccggcggcgcggtggccctcggcgcgagcgccttcgccgccgtacgcctcacccgcgaggaacccggcggcggcggggacggcgctcccggcggacggcgctggatcatcggcgtgcacgccgacctc

SEQ ID NO: 4602 - DNA, 817 bp, Unknown
  Kingdom: Bacteria, Phylum: Actinobacteria, Class: Actinobacteria, Order: Streptomycetales, Family: Streptomycetaceae, Genus: Streptomyces
gttctcacccgactcgtcgcggccgcccggctgttggctgatcgcggggccggaacccgagggcccgggggtgatcgactcgaccgggtcggagccgccggacttgccgtcgttccggcctcccccaccgcctccggacgtcacaccccaggcgatcagcacggcgagcagcgcaaccagaagtcccgctaccgcccttcgtcgccagtagatgctggagggaagcggaccgaccggattgcgcatagatcccacggcccgaactctacgagagatccggaccgactcaggccccacccgccgctccggccgcaagttttgccgatcatcatcacggggatccggtcacaggggacagaacgggtggcgttgtcacctcctgggccgcctcgtgggccgacacccccgcgcccgtgaccgccgctccctcttccgtgccaggatcgtccgtgcgatgactgccatgacttcgacacagacgccccccgccgccgcctccctccacacccccgtcatcgggtggttcgagcagcatgcccgcgatctgccctggcgccgccccgaagcgggcgcgtggggtgtgatggtcagcgagttcatgctgcagcagaccccggtgagccgggtcctcccggtgtacgaacagtggctcgcccgctggccccgccccgccgacctcgccgcagaggcgcccggggaggcggtccgcgcctggggccgcctcggctacccgcgccgtgcgctgcgcctgcacggggccgcgcaggcgataacggaacggcacggcggcgatgtgcccagcgagcactcccagctg

SEQ ID NO: 4603 - DNA, 516 bp, Unknown
  Kingdom: Bacteria, Phylum: Actinobacteria, Class: Actinobacteria, Order: Streptomycetales, Family: Streptomycetaceae, Genus: Streptomyces
acccggatcccgtcgcgggcgaactgcacccccagctcgcgcgacatcgccaggaccccgcccttggacgcggtgtacgagatctgcgaggtggcggcgcccatccgggccacgaaggacgcggtgttgatgatggagcccctgccctggtcgcgcatataggggatcgccgccttgcagcagaggaacacggaggtcaggttggtctcctgcacccgccgccaggcctccaggccggtgtccaggatggagtcgtcgtccggcggggagatccccgcgttgttgaacgcgatgtcgaccgagccgtaggtgtcgaacgcggccttgaagagggcgtccacctgctcggcgtcggtgacgtcggtacggacgaagagcccggcggtctcggcggcggcggccttaccgcgctcctcgtccacatcggcgcagacgacgtgcgcaccctcggaggccagccgccgggcggtggccagtccgatgccgctgccggctccggtgacgacggcggtgcgg

SEQ ID NO: 4604 - DNA, 577 bp, Unknown
  Kingdom: Bacteria, Phylum: Actinobacteria, Class: Actinobacteria, Order: Streptomycetales, Family: Streptomycetaceae, Genus: Streptomyces
cgcgtacaccgtgccgccggtggtggccggcggcacggtgtacgcggcgacgggtgagctgtgccgggcgctggacgtgaaccggggtgcggtgcagcgcggttgggaggtcacggacgtccgggacctcgccgcggacccgtccggctggtacgcccggatcggcacgaaggcgatacgggcgtacaaccacacggccgcgccggtgcggggcttttgaggaacccggtgttcaggcccctcaaccgcccgcgcgcgagcgggccttgaacgccgccttgcgggcgtccttggcggccttcttgtcgctgtgcagccggcccatggcctccagcacttcggcggtggccgggtggtcgacgcgccagacctcgtcgaagaagccgctgtgctgcgcggagagaccctcgatcaggccctggagctcgtccagttcgccgtccgcgtccagttgggcggcgatggtgtcgatggccagccagaagatcatgtcctccggcggggcgggaacgtcggccgcgccgcgctccgcgagccagacgcgggccaggccgcccagctccgggtcgccgagcac

SEQ ID NO: 4605 - DNA, 644 bp, Unknown
  Kingdom: Bacteria, Phylum: Actinobacteria, Class: Actinobacteria, Order: Streptomycetales, Family: Streptomycetaceae, Genus: Streptomyces
  misc_feature (171)..(205): n is a, c, g, or t
gcggtccgtcggggaacgggttgtgaccgagcagccggagcgtgtcccggtcgccgtcgagcagccgctcggcgaagggcccgaaccaggagcgggcgtacgcgggggagagcgccgcgaaccacatcatccagtcgagccgcagatggtacggggcgaacaggcgcggcnnnnnnnnnnnnnnnnnnnnnnnnnnnnnnnnnnntccggcgcggatcgcccggcttgccgcgaaagccgtactcccgccactcggccccctcgcgcgccgtcggatccgcgctgccctccaccacgacctccaggcgcatccggctgatggaaccgaacgcgccataggtgttgaccaggtgcagcggatcgtaggaccggttcatggcctgccgtcgcgagagcagattgcgcgccgggcggtagctgagcaccagcaccagggcggtgaccgcgatgacgaccgcctcgtaccagaggggcggcgcggcctgggccggcggcggccggtctgatggtcctcacccagctctggctggtcctgtcggggaacttcgcctggctgaactggctcaccatcacgctggcgctctccgcgatcgactggactcccctggccgggccgccgccggcccaggccgcgccgcccctct

SEQ ID NO: 4606 - DNA, 770 bp, Unknown
  Kingdom: Bacteria, Phylum: Actinobacteria, Class: Actinobacteria, Order: Streptomycetales, Family: Streptomycetaceae, Genus: Streptomyces
ttgcgggcgtgggcggggaagtggtgtccggcgatctccgcgcgcaatcgggtcccggcgggcagccggcggcccagggtgccgagggacacgctgatctccgcggcctcgccgggtgggccggtgcgccggacgatgccgaaggcgagcggatccgcgtggccggtcgggtcgagtgcggtcaggcgtacggcccagtcggcacaggttgtgtcggccgtgacgttgatccgggcgacggcggctcccgccaggtcgagcgggcggggcagcggcggcgagaggagcagacagcggtcggcgcggtcgccgtcgaccgggacgtcgaggtcgtcggagcgcacgggacggtccgggtcggcgtcgaactcggctccgtggaggagccgtagaccggtgggcgagccgaaggaccagcggcgctccgatccctcctgcggggtggtgtccggcgcggtggcgtccggtgtgctcaggggtcggggggtgctgagccaacgcccgctgtcgccgagggcgatgactccgtgccgtgtcggctccagtcgtccggcgagcgccgcgcgcgcccaccgtacgtacagcgcaccgaggttgacgcgtgcgcgcgccggtgcggcagggtcggcggtgaggcggtggccccagggcccgagcagcaggcgggacggcccgccccagccgcaccacagggccacggtgtcctcggcgaacgggtcacgggtgccgccgacggcgagcagcggaaggcgggcggcggagcccagcgc

SEQ ID NO: 4607 - DNA, 774 bp, Unknown
  Kingdom: Bacteria, Phylum: Actinobacteria, Class: Actinobacteria, Order: Streptomycetales, Family: Streptomycetaceae, Genus: Streptomyces
ccgccgtactcctgccacgtgccgccctgcgccggaacggcggacggcggactgccgcgacccttgcggcgaccgaggagcccgccacgcccggagccggtgtcccggccgcccagctgcgagacgtcgtccgtctgccgggcgaacaactccgtgtcggtcacccgcagctccgcgccgaacagcgtcgacagggcgggtcgcggccggcccgtctggagcgccacgacctcccgcaacacccccgtcagctgctcggccatctccgctgcggaagcgaaccggcgggccgggtccgggtcggtggcccgcaccagcagccggtagaacgactcgtaggtgcggaacacctcgatgttgtccgggtccggcagggagtccacgaagacgttcgtgtacccctggaagtcgaaggtgaggaccgccagcgtccgggccaccgtgtacaggtcggaggcgaccgacggacccagctccgcgacctcgggggcctggtagccgaccgtcccgtagatcgccgactcgtcgtcgtccatccggcgcaccgcgcccatgtcgatcagcttgagctggtcctcggtctggatcgcgttgtcgaccttgaagtcgcagtagaggaggtggcggctgtgcagatggccgagcgcctccagcgcctcgatcccgtacgcacaggcctgctcgaccggcagcgggtcgcgctttccggccggggtgcgccgctcgttggcgatctccttgagcgccttgccgccgacgtactccatcacgatg

SEQ ID NO: 4608 - DNA, 895 bp, Unknown
  Kingdom: Bacteria, Phylum: Actinobacteria, Class: Actinobacteria, Order: Streptomycetales, Family: Streptomycetaceae, Genus: Streptomyces
  misc_feature (286)..(287): n is a, c, g, or t
ggcccgcgccggcgtccaccggaccacggtctaccggcgctgggaggacgtcggcggcctgctcgccgatgtcctcgacgctgcgggcgaggacgactgggagcccgcggacacgggctccctgcgcggcgatctgacggccctcaacgacgagatccaggagtccctggtcgtgcggccgtcgatcccccaggcactgatggccgcctcgttccgctccgcgcgggccgccggcgcccagcagcggctgtgggaggaccggtacgcgcgctgcgagatcatcgtnncgcggcgaactcccgtcgcacaccgatgcgcggcgtctgctgatcgcctccaccgcaccgctctaccaccagttggtactcctgcggaccgctcccgatccggagatgtcctcccatgccgcgaccacgaccaccctggccgccgccgccggcgcattcgaccgcaccgcgtcggacgaggaagagagcggacctcaagtgacccggttgggaatacgaactgattttccataagatccggcgatgatcactagaaaacggctgacgaccggggtgggcatagcgctcgccaccctggccgccgggctcggcaccgcgatccccgccgcggccgacgaagcccccgccgcaccctccccccaggtcgagctggtgctcgacgtcagcggctcgatgcggacccgcgacatcgacgaccagtcccggatggccgccgccaagcaggcgttcaacgacgtcctggacgcggcgcccgaggaggtgcacctcggcatccggacgctcggcgcggactacccgggcgaggaccgcaaggtcggctgcaaggacacccggcagctctatccggtcggcccgctggaccgcaccgaggccaaggccgcggtcgc

SEQ ID NO: 4609 - DNA, 1004 bp, Unknown
  Kingdom: Bacteria, Phylum: Actinobacteria, Class: Actinobacteria, Order: Streptomycetales, Family: Streptomycetaceae, Genus: Streptomyces
cgccgaagaggcgcaggagcgctgacgtaacgccaggccgtccgcccgcctccgtcacctgccgcccgtcggcgacggaggcgggggcggccccgggcggtcagtgaccgacgagctcgccgtcccgggcgacgacgcgcccgccgcgcaccaccatctcgcgccgcggcaggtcgaccacggcctgcgggaggcactccccgcgcatcagcaggaagtcggccgaccggcagcaccaggtccgacgaggcggcgaccgtcggcagggagatcccggcgtccgccaggctcgccgccggccggtcgagcttccgctcgggcagtccgggcacgcagaagacatggctgacggtgaccttgccctgcgacgacagcgctgttgcccgccacggacgccatcctccgttgtgcgtgccaccggccgaggacgcgcggggcccggggccgtcaggccgtgcccggggtccgcccttccggaaggaagagcaccgagttgatgtaccgctcgcggtgcgggacgaaggcccggcgcagcagaccctggtgcaccaggtgctccgtacgcgcctggtgggccaccaggtcgaacccgtcgagcgtgatccagcggcggcccgctaggagccagcccgcgtagccctgaccggtcagcaggtcgaccgccggttcgatcgggccgagccggctctccagctcgatgagcagggccgggcggtccttgcgcagcagctccgccgcaccgagcagtgccgcccgctcgccgccgtcgacgtccatcttcacgaagccgaccccgctcagcccgagactgtcgacggtgatcgacggcacctccaggcagtgtgcgtggatgtcgcggcgggccagcgacgacaccccccggtcgccccggtcgccctccgggaaccacagctgtgccgtgcccacccggtcggtcgccgcgccctggaccacccgggcgttcgacggcagcgtccggcgcaggtgttcggccagatgcggca

SEQ ID NO: 4610 - DNA, 884 bp, Unknown
  Kingdom: Bacteria, Phylum: Actinobacteria, Class: Actinobacteria, Order: Streptomycetales, Family: Streptomycetaceae, Genus: Streptomyces
ggtttgggggcggtcgggggcggtacgagcggcagcgacggcgatagcggtacgaagggtggggcctgcggcggcggcgacggtacgggcaggggtgcgggcgcttccggtgcggactgttcggacggcccggtgtgcccggacgccgggttcggtgcgggtgcgggtggttgtggccgtgctggtgccgggcggtgggggcgtagcagtgcggtgggctggttgcagaagacggtgcgggtgatgacccggccgctgggcaggcggtcgcggacgcgttgcaggtagccgaaggcttccagttcgcgcagggcggcggcgatgcgtttctcgccctctcggcagcgggcggcgagtgccttgatgccgacttcgatcccttgggggagggactggatgcggacggcgatgccgactgcggtgcagctgaggtcggggtgctgggcgaggtggttgccgacgacggtgaagcggtcggtgtgggggatggcgatgtggatcacgccggaggtgggcagtggtccgggaacctctgccagcgcgcgcgtgagcgcagtattctgctgggtatccatcgggaagccctaacttcctaggtggtcaggccctcggttgggattgcagtcccggtcgggggccgacgtatgtctggtgcggtctggcgtgagcatatgccggacaacctgcccgaaagcgagctgagttggaaaacctcacccgtgcgggtgacgagccccctggggtgcgtcaggtggtcaccggggtgggtcgggtggggttatttctcttgtttctttgagtagttgatgtcgcgcttcaccgggtcgcggtggcgaacgattcggtcggggtacgtgggcgcgtaccgggtcgcaccggcgcac

SEQ ID NO: 4611 - DNA, 678 bp, Unknown
  Kingdom: Bacteria, Phylum: Actinobacteria, Class: Actinobacteria, Order: Streptomycetales, Family: Streptomycetaceae, Genus: Streptomyces
gggcgacgggagccgcgacgtgggcgccgagcgcggtgaggatgtccagggtgcgggcatgccggacggcggcccgggcggtgtccgggaagcgggcgacggcgaccggccaggcggccggtacgagggctccggacaggtcgctgatcaccgtgacgtcgtccgggcacatctcggcggggctgagcaggacggtgtcccgcggccggtgcacggtgtcgcgccaggtctcgtcgctgatgacgtgcaagccttcgccgaccgccgcctcgcaggcctcgcggaccagttcgggcggggcgacggtggccgtgggatcgtccacgacggacagcagcagcagtttcggccggccgccctccgcacggacccggcggacggtctccagcagggcgtacgggtcgggcacaccgccgcattcggccggggtcggcacatggtaggcgggacggcccagcagccgggcctgcggcatccaggtggccggacagggacgcggcatgaggacgtcgccgccgtgtgcgccgatcagggccaggaggagcggctgggcgccgggggcggcggcgatgccgcccgccgtgccgtgcagtccgcgccggtcccagtagccgcgcgccgcctcgcgcaggaccgtccctccaccggggggttccgggcgcggctactgggaccggc

SEQ ID NO: 4612 - DNA, 682 bp, Unknown
  Kingdom: Bacteria, Phylum: Actinobacteria, Class: Actinobacteria, Order: Streptomycetales, Family: Streptomycetaceae, Genus: Streptomyces
gcggggtgcggtccgccgccggccggggatcccgtcccctggccggggacccccgccgagctggtgctcccggtccaccccgggccccgccacgactggttcaccgaggccgcgctccgtacgctcctcaccgccgcctaccgggtctcgccgcacagcaaccgcatcggtctgcgcacggagggtcctgcgctggagcggtcgcgtacggatgaactgcccagcgagggcatggtcctgggcgcggtccaggtgccgccggacggccggcccgtcgtcttcctcaacgaccatccgacgaccggcggctacccggtcgtcggcgtcgtccccgaacgggccctcgccgcggcggcgcaggcggtgccgggcaccgggttgcgcttcgtacgcgcctgagcgcggcgggacctttcggtcccgccgcgctcaggtcgtccgtaccttcgtgctccttcacgcccccttgaaggtgcgcaggcgcagggagttgccgaccacgaagacggaggagaaggccatcgcggcaccggcgatcatcgggttgaggagtccggcggcggccagcggcagcgcgccgacgttgtaggcgaaggcccagaacaggttggtgcggatggtggagagggtgcggcgggagaggcggatcgcgtcggcggcggcgttgaggtcgccgcggacg

SEQ ID NO: 4613 - DNA, 543 bp, Unknown
  Kingdom: Bacteria, Phylum: Actinobacteria, Class: Actinobacteria, Order: Streptomycetales, Family: Streptomycetaceae, Genus: Streptomyces
gtccgcagccctccagcggcaccagcagcgacgacggcgggctgggtctcggatggctgatcggcatcggcctcgtcttcggcgcgggcatcggcttcctgctcagcatgcgccggaagaagcagcagccgtgaggcgtacgccggtcccggcgcgactgcggaatcctgtcgtcgcgcggctgcgaaatcccgtcgcgcggctgcggaatcccgtcgtcgcactgctggccgccctggtcgccgcatcggccgtcctgctcggcgcgggcagcgcggaggccgctggataccgctactggtccttctgggacggcaacggcaagaactgggagtacgccacccaggggccgtcgctgctgcgcccggacgacggtgcggtccagggtttccggttcgccgtgagcgaggactcgggcgatgccgcacagccgcgccgcgcacccgacttcggggcgatctgcgcggacaccccggcgaaggacgggcagaagcgggtggcgctggtgatcgaccccggtacggcggcggacgctcctgacgg

SEQ ID NO: 4614 - DNA, 1341 bp, Unknown
  Kingdom: Bacteria, Phylum: Actinobacteria, Class: Actinobacteria, Order: Streptomycetales, Family: Streptomycetaceae, Genus: Streptomyces
gcgccgcgtccaccagccgcgcccaggtgccggccacgcggtgcgcgtcggaggtggccgcgtccagcagcagccgggcctcctcgaccgtcggggcccggtcctcccacaccaggccggccgccgttcgcaggaccaggggctcggcgaagggggagaggccggccgcccgcagcacccggtgccacaccgccgcccggtcaccgcccagggtcgccatcgcctccggcacctcggcgcacatccgcagatgcggcagcgcctgtgtacccgtgaacggcagtgcgacccgctccaggaaccgggccaccgccccggggtcctgcggcgcgatccggtccagcgcgccgagcagcgccgtccgcacctcgaactgctcgtccagcagctccagcagggcaggtgcgaaacccggggggccttcgtgcgccgccgacgcctccgccagcagcgcgggtgccaggcggtccaccacccccggcagcgactccgtaccgtccacgcccagcagccgtgccacccgcagcagttgcacggtgcgcgccaccgagcgcgatccgaccgtgtcggccagctcggtcaggatctccgggcccagccgctcggcgacctccgccccctccggaccggcgaacgcgtcccggcgcggcagttccagggagccgttgccgccccgtaccgcctccgtgaccagcatcgccgcgagcggcgcggtcaccgacgccgcgcagcgaccctccagcgcaccgaacagccgtcccacggcgtcgaattcgggtgccgtacggtcgtcgataccgggtgaggcgagagcctccaccaactggcccgtgcgcttcgcgtccagcgcgtacggccgatcggcggcccacccggccgccgccgcacgctcgtccggcccgagcacgatccccgcgcagagtgcggtcaccgccaacggtcctgccgcgaacggctccccgggaagttcccgcgcctcccggaacagctccggcgaccggctccgccagacccgggccgccgtggtcgcccacacgtcctccgtgccgcttgccggggccgggcccgcgcactcgtgcacgcgcaggcccgccgctcgtgccgccgccgcgtcctcgggcagcacccccaccacccgtaccgtcgaactccccggccgccgggtgtacgtggtgaacgtcagccgctccgcgctctccctcggcagggtgaccgaggcgaggcccagccaccgggcaacgtccgcgcactgccgctccaccagcgccaccggtcggccgccggccggctccgcgtcgctcgcccggcgcagatccgccagcacggccgcgagccaggggc

SEQ ID NO: 4615 - DNA, 573 bp, Unknown
  Kingdom: Bacteria, Phylum: Actinobacteria, Class: Actinobacteria, Order: Streptomycetales, Family: Streptomycetaceae, Genus: Streptomyces
ccggcgacggccgccccggcaaccgcttcggcgcccgcgtcccggaggtcaccgccgaggtcgtcagcaccggcggcgcgcagcacggcgacgcccggctggcggtgacggcccggacctcgggggccgtcacgacgctcacgctgaccgcctccggccgggggccggtcagctggtcggcggcgacggacgcaccgtggctgcgcctcagccgtacgtccggcacgctcgcggccgggcagagcaccacgatcgcggtctcggtgatccgggacgcacagccgggcggcccgtggcgagcccggatctcgctgaccccctcgggctccgccgtgctcatcgacggtcacggggtcacgtccccgacgacgggcggcccgcgccccacgcgacccggaacgggctccccccgtcccacggaccccggcccgaccgatccgggcccgaccgatcccggcccgaccgacccgggtcccaccgaccccggaccgcgcccgaccgatccgccggaacccaccgatccaccggacccgaccggaccgcccgaccccacggacccgcccgaaccgacac

SEQ ID NO: 4616 - DNA, 1049 bp, Unknown
  Kingdom: Bacteria, Phylum: Actinobacteria, Class: Actinobacteria, Order: Streptomycetales, Family: Streptomycetaceae, Genus: Streptomyces
gcacagggccccttcccggccgggctgtccggcggcgccgagcagcgcgtcgaccgtccccgggccgaggaacggaagatcggcggagagcacgagaacgtgctccgccgtcgtgagtcgcagccccgcccccagagccgccaacgggccgccgccctcgggcacttcacgggcccagacgaccggtctggcggtggcgcgacgaccgccgaccacgacggtgcgtgccgcgccgtcgcacgccgagagcacgcggtcgagcagcgcccggccgcccacccgcactcctggcttgtcggcgccgccgagccgcttcgcggccccgccggcaaggacgatcacgtcataggcggtcatacgtcgagtatgggcggcggcccggagcggcgcgcccgccggggtggccgcaagacccggtcccggagggcgcggccggcaggacaccggctgctcggctacagggtgcgcagcagcaccgccggctgctccacgcagtccgccacataccggaggaagccgcccgccgtcccgccgtcgcacacccggtggtcgaaggtgagcgacagctggacgacctgacgtacggccagctctccctggtgcacccacggcttgggcatgatccggccgacgccgagcatcgccgcttccgggtggttgatgatcggcgtcgaaccgtcgaccccgaacaccccgtagttgttcagcgtgaacgtgccgccggtcagctgggccgggctcagcttcccggtccgcgccagctcggtcagccgggcgatctcggccccgatcgactcggcgttacgggtgtgcgcgtcccggacgaccggaacgacgaggccccgctcggtctgggccgcgaacccgaggtgcacgccgggcagccggacgatctcccgggcctccgtgtccacggtggagttgagctcggggaaccgggccagcgccgccgtgcagatcctcgccagcagggccaggaccgacaccttcggcccggcggacgggcccgtggccgcgttcatcgcggccctgaccgccatcagctcggt

SEQ ID NO: 4617 - DNA, 776 bp, Unknown
  Kingdom: Bacteria, Phylum: Actinobacteria, Class: Actinobacteria, Order: Streptomycetales, Family: Streptomycetaceae, Genus: Streptomyces
gtcgccgatcagttcccggctgcgggcggtctcccggtgcagttcctcgtccggaagagctgtcagatcccggtggtacagaccgtgcgagccgacctccatgcccgcggcggtgacccgccggacgtcgtcgtgggtgagcagcggcttgcgcgggccgagcggatcccactcgttgacgccgcccggccggcccggcagaacgaagaccgtcgcccggaagccgtgcttgcgcagcaccggcagcgcctcgtcgaggaagtccgcgtacccgtcgtcgaaggtcagcccgaccagcccgcgccgccccgcgtctcccgcgcgcagcagctcggacacccccaccccggtcagccgccggctgcgcagccaggacagctgctcgtcgaggcgaccgggggagacggtgatgccgtacggatcgtcgctcgggtccgtcaccgagtgatacgtgaggatccacggctggcgtcgggtgtgcgggcggagccgggacgagggagcgtcggcgcgacgtgccgaggaatcagcggccatcaaggaacctccgtcgggtgagtgccagcagggatacgacctcgggcgagcgcagggcgagcccggtcaggaagaacacggaggggacgaggagacacccggcggccaggctcagcaccggatcgggaacgaggggagcgcacgcccagccggccacgccggccgccagcgacgccccggtgagccgggccagcgagagcgccaccgcccgcgtccggatcggcaccacccgggtgccg

SEQ ID NO: 4618 - DNA, 1110 bp, Unknown
  Kingdom: Bacteria, Phylum: Actinobacteria, Class: Actinobacteria, Order: Streptomycetales, Family: Streptomycetaceae, Genus: Streptomyces
gtccacggcgtcctcgtcgcggtcggcccagtcgttgagggccatcccggcctcgtacaggcacagcgacgcgccgatcgcccgtgcggtgccccggccgggtcggcggcccaccgccgccgcgcccgccagggcgtccccgggtacggagaagagggcggagacccgcagcagttccgcccaggcccgcaggcgctcccggggcgcaccccggccggatcccgtgtccggccggtccccggcggcgtgcgcgccccgttccccgtgccggcccgtggagggcggtccgggcctgtccggtgcgggcgcagtcccacccgcaccggacaggctgtcatgggtcacggcggccgggccgccgtgggaaaagccgttccgccgcccgggcgggagcaccgacagggccgccgcgaggacggccgggagggcgttccgtcgccacctcatgcctgggcccgcagccgctcggcgaaggtgagcaaggtggcgtactgctcggcgagggccgccgaggtgccgccgtccgggtccttgaagtagaagccgagctccggcagcgggccgctgatcccggtctcgtgggcgcgggcgagcagccgtgccaggtccaggaccagtggggccgcgagggccgagtcgcagccctgccagatggtctggaggatcatccgggagccgaggaagccgtcgaaggcgatgtggtcccaggcggtcttccagtcccccatcgcgggcacgtcgtcgatgtgcacctcgccctcgggggcggtgccgaaggtgtcggcgaggacgcgttccttgccggcgttcttggcggccgctgccgccggatcggccagcgccgctccgtccccgccgcccagcaggttcgacccggaccacgcccgtacggcgagggcccgctggaggaacatcggggcgagtacggagcggagcagcgtctggccggtcttgccgtcgcgtccggcgtggggaagtccgctggaggcgacggtgtcggtgagcgcgggggtgcgcaggccggtggacggggtgaagttggcgtaggagcagccggcccgcagggcggcggccgcgtagagcgagctggcgggcagccgggtgtcgtcg

SEQ ID NO: 4619 - DNA, 522 bp, Unknown
  Kingdom: Bacteria, Phylum: Actinobacteria, Class: Actinobacteria, Order: Streptomycetales, Family: Streptomycetaceae, Genus: Streptomyces
ggactccacttccacgccctcgacgaggacgccggctcggccgcgtacaccgtgcagataggcctcggcctggagggcgacctcgacaccggcgcgatgcgccgggccgccgaagcgctgctcgaccgccacgccggcctgcgggcgggcttcgtgcacgaaggtctcgacgcccccgtccaggtcatcgcctccggggcgccgctgccctggtcgcagcaggacctgcgcgcgctgcccgcggcggaacgtgacgccgtcctcgcccggatcctggacgaggaccgggcacaccgcttcgacccggccgacccgcccctgctccgtttcaccgtcatccgcctcgacgaggatcaccaccacctcgtcctcacctacgaccacctgctcctcgacggctggtccaccgccgtcctgatgcgcgagctgttcgccctgtacgcgaatggctccgacaccagcgctctgccgcgcgtcacccccttccgcgagcacctcgaccggctggcccggcaggaccgg

SEQ ID NO: 4620 - DNA, 537 bp, Unknown
  Kingdom: Bacteria, Phylum: Actinobacteria, Class: Actinobacteria, Order: Streptomycetales, Family: Streptomycetaceae, Genus: Streptomyces
tcgtgggcgcgggcccgcgcggtgagggccgcggtgacgtcctcggacagggtgacgacgtgctccacgacggtgacccggccggtcggggggaccggtgcggccagcggggcggcgtcgggcaggtcctccaggaccacgcgccaggcgtcctcgtcggcggcggcgtcgaacccgtccagccagtccccgtaagcctgttgggccggagggggagcaggcgggagcatcgcctcgtccgcaccggtcatgtagatcatccacagctcgcccagcaccagcggcaacgaccagccgtccagcagcagcggggccagggtcaggacgaaccgccagtcgccggggcccacctcgacggcggcgcaccgcaccagcgggggccgcgccaggtcgaacggggtgtcccggtcggtctccagcaactgccggagccgctcgtcccgctcctccaccggagcgtccgacaggtcgaactcggcgagcaccggcgtcacttcgtcgccgatcagctgaaccggaccgccggacccgctgcgg

SEQ ID NO: 4621 - DNA, 962 bp, Unknown
  Kingdom: Bacteria, Phylum: Actinobacteria, Class: Actinobacteria, Order: Streptomycetales, Family: Streptomycetaceae, Genus: Streptomyces
ccgaacccctctgctcccgctcccgcgccggcggagggacggcgggacccggcgcgggagcgggagcagaggggttcggtgtggagagggccgtcggcgggtgcgtcgccgaggccgcacgggccgcgttcggcgcggcggggtccccgagcacctcgcggagcatcgcctccgccgtggccgcgtccaggcgctcccgcgggtccgtgatcaacagcccctggacgaccggggcgaggggtccggcgaagcggatggccgggtcgggggactgccggatgttctcctggacctcccagacctcgttcccggcgaagggcatgcggccctcggccatctcgtacagggtgacgcccagcgcccacaggtcggaggcgggtgtggggcccggagaggcgggggcgaagagctcgggtgccaggtaggggggagtgccgatgacgcttccggaccgggtcacccggtccgcgccctcgaaggtggcgatgccgaagtccaccaggatcgcgaggccgtcgtcccggacgaggacgttgcccggcttcacgtcgcggtggacgaccgaggccgcgtggaccgcccgcaggccctggatgacctggaggccgatgttcgcggccctcggcacggagaggaccccttcgccgctcaacaggtcccccagggacctcgcttcgagcagcttcatcacgatccagacctggttgtcggtctcgacctggtcgtggaccgtcaccacgttctggtgctcgatcttggcgatggcctccgcctcgcgccgcgcccgctgcatcgcggccgtctgcgtggccggggtcatggcgttccggtcgagcaggcccttcacggcgacgaaccggcgcagccgcaggtcgtgggccttccagacctcgcccatcccgccgctgccgatcggttccagcagctcgtagcggccgtcgatcacggtgcggggggagggc

SEQ ID NO: 4622 - DNA, 503 bp, Unknown
  Kingdom: Bacteria, Phylum: Actinobacteria, Class: Actinobacteria, Order: Streptomycetales, Family: Streptomycetaceae, Genus: Streptomyces
ggtcggggccgccggggtgttcggggagcagggcgtcgagcgcgtacccggagatgcggcgcgggaggtcgggacagccggtgcgcaggagggcgaggtgggcggcgacgagcgcgccgaccccctcggggccctggccgctcccctgttccagacgcagggcctcgcccccgtagcggaccaccgacagcttccgcacgttgtccgccgtcgtgccccaggccaccgagtgcgcgccgcaggagttgttgccgatcatgccgccgagggtgcagcggctgtgggtggaggggtcggggccgaaggtcaggccgtggggtgcggcggcggcccgcaggtcgtccaggatcacgccgggctggacgacggcggtgcgggcgacggggtccaggtcgaggatcgcgcgtagatgacgggtcaggtcgaggacgagtccggtgccggtggcctgcccggcgatggacgtgccgcctccgcgcgcgaccaccggcaccggactcgtc

SEQ ID NO: 4623 - DNA, 667 bp, Unknown
  Kingdom: Bacteria, Phylum: Actinobacteria, Class: Actinobacteria, Order: Streptomycetales, Family: Streptomycetaceae, Genus: Streptomyces
cacgtcggcctcgccgccccggaccgggggcggcgaggccgacgtgctgcgcggattcctcgactacctgcgcgactcggtcgcggcgaaggtcgcgggcgctcaggaaccggaggtccgcgccgccggggtgccctcgggcacgaatctgctcggcctgctcagccatctgacgtccgtcgagcggtccctgttcctcggggagcgggtcgacgactggccggcgaccttccacgccgcacccgaggacggcgtggccgaggtcgtcgcccgctaccgggaggcggtcgcggaggcgaacggcgtactcgacacctgtgtcgacctcggcgcacgggtgccacgcccgcacgcgggggactccgcacccagcacccgttgggctctcacgcacatgatcgaggagaccggccgccacgccggtcacgcggacatcctccgcgagctgatcgacggctcgacggggcgctgaaccggggagctcctcagctccgcggggcaccgtcgaaccccggccgccgcacgggggcggttcccgtctccggcggtgcggctgcggactccggtcgtacgggggcgactgcggactccggcggtgcgggcacggtcccgctctcccccggtgcgggggccaaatccgggcggccctccgcacgcagtccgaggc

SEQ ID NO: 4624 - DNA, 713 bp, Unknown
  Kingdom: Bacteria, Phylum: Actinobacteria, Class: Actinobacteria, Order: Streptomycetales, Family: Streptomycetaceae, Genus: Streptomyces
ggcggcggggagccccaacttgcacggaccgcactgtccggcggtctcggcggccagccagttggctatccggagggactcgccgagcgggcaggtgtccggcccgatcggcaggatggcgcccgcgccgagcgcgccccccacggtggccagggagtcgcgggagaccacggcgttgtgcgaggagaccgcgtcgatccagttgccgtgatagccgccggtcagcacgccctgggggagcggcggggcgccggccagttgcaggacgtaccgcagcggtactccggtcggcacctcgatgaccatgggccgggccacggcgccggagacggtgagcaggacggtgccgggctcgctcggcagcccggtgtgcccgtagcggcgggacccgatccgggcggcgacggcgagctgggcgtacgtctccgcgttcgacagcagcgtcggggcaccgcccaccccggtctccgccgcccgctcgcgccggcccggcggcagtgcgggcccgccgttcgccgcccggatcactgaggacgcctcgcccgagaccatgcgctccggggtgcggaccacccgggcgcgcagctgctggccgcgccggtcggagaggccgcgttcggcgagcgccgcccgtacggaggtctccgtggagttgcgggtgacggcgacgaccagggtgcgcgcgccgagcgcctccgcggccagcagcgcac

SEQ ID NO: 4625 - DNA, 1069 bp, Unknown
  Kingdom: Bacteria, Phylum: Actinobacteria, Class: Actinobacteria, Order: Streptomycetales, Family: Streptomycetaceae, Genus: Streptomyces
gtcccaggccgctccggaggtcaccgaggctcccgaggcctcaggggtaccggcagccgcagaggcgccggagaccacggagacgccggccgtcgcggagacccccgcggcccctgccgcaccggagcccgtcgccaccgcatccgaacccgtcgccgccgcaccggagccggtcgtcaccgccccggaacccgtcgccgccgtgtcggaggctgcccccggcaagcccgccaccacgctcgcgcgggtcaagtcgcgtgctccgcagctcgtcgccccgtacaaggcggcgcagacagcgctcaaggcacacgggctgaccgggctccgcgcccgcgtctacctggtgctcgaccgctccggctcgatgcggccgttctacaaggacggcagcgcccagcacctgggcgaccggacgctggcgctcgccgcgcacctggacgaggacgccaccgtgccggtcgtcttcttctcgacggacatcgacggcaccggcgccatcgagctctccggacacgagggccgcgtcgacgagctgcacgcgggcctcggccggctgggccggacgcactaccaccgtgcgatcgaggagatcgtcgcgcactacgagaagacggaggccaccggcccggctctcgtgatcttccagacggacggtccgccggacgccaagcaggccgcccggcaggccctcacggaggcggcgcggctgccgctgttcttccagttcgtcgccttcggcgagcaggacgcgaagggcttcgacttcctccggaagctcgacgccccgaacgccggcttcttccacgctggcccggcgccgcgcgaggtcgccgacgccgagctctaccgcgagatcctcgccgggctgccggcctggaccgccgcgcgcgcggccggctccgaggcctgatcgaccggcagccgtacggtcacggcgaggccgccgccctcagggcccggtatcgccgtgaccgtaccgccgtgggccaccgcgatcgaccggacgatcgaaagaccgaggcccgaccccggacccatccggtcccggccctcgccccgccggaac

SEQ ID NO: 4626 - DNA, 552 bp, Unknown
  Kingdom: Bacteria, Phylum: Actinobacteria, Class: Actinobacteria, Order: Streptomycetales, Family: Streptomycetaceae, Genus: Streptomyces
ccgtcgtcctcgcgggcgcccgcgagcagtccggctggtggggcaagggcaccccggcgacctgggcggacgcggtcgaggccgcccggtccatcgccgcggaggccggtgtggaggtcatcgtccgcgccgaccagcacgccccgtggcacccgggccgctgcgccgcgctgtacgtcaccgtggacggcgaggagaccctcttcggacacgcgggcgaactgcacccgcgcgtgatcaaggcgctccacctgcccgagcggacctgtgccgcggaggtcgagctggacgtgctggagcgggccgtcgacggagcgctccgggcgccgaggatctccaccttcccggtggcgacccaggacgtcgcgctcgtcgtcgccggggacgtcccggccgccgacgtggagcgggcactgcgcgagggcgcgggtgaactcctcgaatcgctgcggctgttcgacgtcttcaccggcgagcagatcggcgggggcaacaagtccctggcgtacgcgctgcgcttccgcgccgccgaccgcacgctgaccgtcgagg

SEQ ID NO: 4627 - DNA, 540 bp, Unknown
  Kingdom: Bacteria, Phylum: Actinobacteria, Class: Actinobacteria, Order: Streptomycetales, Family: Streptomycetaceae, Genus: Streptomyces
tccagggcggcggacggggccgtgggcaggagggccagcaccgcctcctcggcggccggggtgcgcaggacgcggatcgcggcgaggaacgggcgcggggtgcgggcggccgggaggagccgggcgacggcctcgccgatggggagttcggcggccccctgccgcgacagggcgatgagcagctccaggcggcgcggccagtccggggaggtgggcggggcggcggtgagggcgtcgaacagcgggcgacggcaggtgtagaggaccgtggcgacgtcctccgccgggagcgtgtggtcggccagggccagggcgaggagcggggcggcgtccgggtccgacgggaagtggccgcgccggtgaagtccgcgcagacaggtcagcacgggtccggcgagcaggagggggtccgtggcggccagggccaccaggcggccgacgtcggtgcggtccgcctgttcgcccaggagctccacggcctgcccgcgcagggccggagcgccggccgggtcctccgccgtgctccacagcaccgtgggg

SEQ ID NO: 4628 - DNA, 578 bp, Unknown
  Kingdom: Bacteria, Phylum: Actinobacteria, Class: Actinobacteria, Order: Streptomycetales, Family: Streptomycetaceae, Genus: Streptomyces
gacggtgggcgtacggcccgaactggccgaagccggtgacccgggccagcaccagacgcgggttgacggcgtgcagctcctcggggcccaggccccagcgctccagggtcccgggccggaagttctcgatgatcacatcggtctcggcggccagttggagcagcacgtcccggccgccgggcgcggacaggtcgagggtcagggtgcgcttgttgcggccgagcagcttccaccacaggccgaccccgtccttggcgggtccgtgcccgcgcgaggggtccggcttgcgggggtgctcgaccttgatcacatcggcgccgaagtccccgagcatggtggcagcgagcggtccggcgaagagggtggccaggtcgatgaccttcagcccggtcaggggtcctgctgcggtggtgctcatgaggcctcgatctcgctccggtagggcatggacgtggaagcgccgggtttctggacgcagagcgcggcggccgacgtggcgaacgccacggcctcggccaccggccgcccctcgccgagcgccacggccagcgccccgacgaaggtgtccccggctccgg

SEQ ID NO: 4629 - DNA, 583 bp, Unknown
  Kingdom: Bacteria, Phylum: Actinobacteria, Class: Actinobacteria, Order: Streptomycetales, Family: Streptomycetaceae, Genus: Streptomyces
gccctcggcttcgacaccgccctcctggtcgacgcggtcgaccggcagaccgggatcgagtcgctcgccgggcccggcaccccgctgctgacggtcaccgaaccgaccgagaccgccaccgcggccgctttcgcgcacaccgccgttctcgccgggaagccgcagaacgccgcgcctctcgcggaggccggccggctcttcgggcggctcgcccacctcctggacgccgtggaggaccgggaggccgacgccgcggcgggcgcctggaacccgctcaccgccaccggcaccccgctgtccgaggcgcgccggctctgcgacgacgcgctgcacggcgtgcggctcgcgctgcgggaggtggagttcaccgacggcaagctcgtccacgtcctcctcgcccatgagctgcggcgctcggtcgaccgggcgttcggcacatcgtcctgctcgcatcaggagggccacgagcaccagggaggccaggggctgctgctgcccgaaggctccttcggtccgccgccgggcaatccgtacggtccgcagcccggccacccgtacggcccgccgcccggcggcccggccg

SEQ ID NO: 4630 - DNA, 894 bp, Unknown
  Kingdom: Bacteria, Phylum: Actinobacteria, Class: Actinobacteria, Order: Streptomycetales, Family: Streptomycetaceae, Genus: Streptomyces
gcgtgcgggaagagcgccgcgcgctccgggtcctccgcggccgccgtgcgcgcggctgccagcaggttggcccgctcgacgcccagccaggccgccgcctcctgggcgtcgccgaactcggccgcgtacaccgacacctgctcgggctccatggccctgcggcgcgggtgggtgaggcagtgggcccggtacgcggaggtgaggcagtaaccgagaagcctgccgacggcatcgccgcgcgcgttctccggctcctcggcgttggacatgcgcagcgcgaacgcccgtgtgaggtcgtgcagttggtagcgtccgagggtcggctcggtcagcagatggcagtccagcagctcctcgatgccgcgccgcacgcccccgtcgccggcgggcccgggcgggctccccgccagggccgccgcagcagccgccgtgatgtcgggaccggggtgcagagcgagcagacgcagtaatcggcgcgtgccgggcgtgagttccgcgtacgagaagcggaacgccgagacgaacacctcctcgtcgagtccgtccagcggatcgctcgactgggccaggcgctccaggagatggcgcaggtcccagatctcccggtgccggaagcggcccgcgagcagcgtcgtggccagcggatggcggtcgcaggcctccaccagcagctccagcgcctccgggtcgcgagaggtccgggcggtgcccgcgatccgggtgaacagggtcgccgcctcccgggccgacagcgcgtccaccggcacggagacggccccgtccagcgcggagagccggttgcggctcgtcacgatcgccaggcatccgggcgagccgggcagcagcgggcgcacctgggcggcgtcccgggcgttgtcgagcacgaccaggacc

SEQ ID NO: 4631 - DNA, 581 bp, Unknown
  Kingdom: Bacteria, Phylum: Actinobacteria, Class: Actinobacteria, Order: Streptomycetales, Family: Streptomycetaceae, Genus: Streptomyces
gcgcgcgccgtccccgcccgggtcctgcgccaccgcggcctccggcacgggagcgcccagcaccaccaccgcgtaacgcccccgttccggcagcccgaggccgcgcgccgcacgctccaccaggtccggcggcgtcccgcccgccagcagcgggccgagcagcgccccgtaccgcgttccacgccgcatccgccgctccgtccccggtccgggcgttcctgatgaccgatgaggatgccagcggccgtgggtgcgggcgcccgcccgtcaccgcgtctgtgcgcgtgcacaacaaggcccttcgttcgctggtcgcccgcatcgagtcggtcccgcgccgtggacgcacgtcccgcccggtgctggtctgtggcaccacacacgacgccatgccttcaccgatgagcacgacaggtgaacacgggacgacaaggcggaaggaggaggacgcatggcaacgctagagatccgcgggctttccgtcggttacggcccggtccgggcgctgcgcgacatctccgtcgacgtgccggacggcgggatcaccgccgtactcggcggcaacggcgcgggcaagacca

SEQ ID NO: 4632 - DNA, 543 bp, Unknown
  Kingdom: Bacteria, Phylum: Actinobacteria, Class: Actinobacteria, Order: Streptomycetales, Family: Streptomycetaceae, Genus: Streptomyces
ccgtgccggccggcacggacggtccggtcgacgctgtcgaggatgacctggcagccgctcccgtgcgccgtcgcggcagacctcagcgccgggccagggccagcacgctcaggccgaacatcaggactcccagggggagatggaccgacggaaggtgcgcgatgccgaccgcgacctggaccgatgccaggaccaggaagccggaggcgtgcaggacggggcggggcgagccgccgcccggcttccagaccagtaccgccgcgagcacgtacagcagggacgccccgtacatcacgcgcgctccggcgctgtgcagcgtctccccgtaggacgaggtcatcagcagtccggaggagaccgcttgaaggaagatcgtcagagtctgcagggcgatcgcgatccgcagaaacgggaatgcgcgccgtgccgtcgccggagtggccatgccacgcctcttttccgcccgtgggcagtcgatcgataaggtctcaccaacccgacgacgggggcgggcgaaaggtaaggcggggggcggcaccatgg

SEQ ID NO: 4633 - DNA, 593 bp, Unknown
  Kingdom: Bacteria, Phylum: Actinobacteria, Class: Actinobacteria, Order: Streptomycetales, Family: Streptomycetaceae, Genus: Streptomyces
gtgagccgaccgacccgaccaccgaccccggcaccccgggcggagccggtgacgacggcggggccggcgacgacgccggtacgggcacgacgcccggcgagacggcgctcggcgccacgacgggataacgcaccaccgcaccagccctgagcccggcgtgcgccctcgtggcgcgcgccgggctcacgcggtggtgcaccgcttcactccgtgaaggccgcgcacaccgcctcgtactcccgcgtccaccacaccgccagggccgacaccgcggggaactgcgggtcggccctgcggtcgtcgaggcgatagcgccagcggagtatccagaagtcgttgagccgctcccaccacacccggtgcaccgcggccgccagttccgcggcccccgccccggcggcccgccggtacgcgcgggcgtacgcccgaaccttcgcgaggtccagctccccggccgggcggacgaagaagatcgccgccgcccgtaccgcctcctcggcgcgcggctgtacggccagccggtcccagtcgacgatcgcgaccgggtcggcgccccggtagagcaggttcagcgggtggaagtccccgtgcac

SEQ ID NO: 4634 - DNA, 538 bp, Unknown
  Kingdom: Bacteria, Phylum: Actinobacteria, Class: Actinobacteria, Order: Streptomycetales, Family: Streptomycetaceae, Genus: Streptomyces
cgccgcgaacatgggcggcctggggtgcggcccgctgctgtccgggatgctcgccgagtacgccccctggccactgcggctccccttcgtcgtccacctggcgctgatcgccgtggccgccgtactgacctggttcctgcccgagacggtcgcctcctcccgggtacggggactgcggctgcggccccaggggttggccgtccctcccgcgatgcgcggcgtgttcaccacctcggcgctggcggccttcgccgggttctccctgctgggtctcttcacggcggtcgcccccgcgttcgtgtccgagacgctcgacgtgcacgacctggctttgacgggactcgtcgtcttctccgtcttcctcgcctcgacggccgggcaggcgctcatggggcgggtcggcgagcgacgggccctgccgggcggctgcttcgtcctggtcgccggactcctgctggtgggcgcctcgttgctgttcgcctcgcttcccctgctcgtcgccggtgcgctgtgcggcggcctcggccaagggctggcg

SEQ ID NO: 4635 - DNA, 663 bp, Unknown
  Kingdom: Bacteria, Phylum: Actinobacteria, Class: Actinobacteria, Order: Streptomycetales, Family: Streptomycetaceae, Genus: Streptomyces
cggcggccaggagtccacgctgaccgtgcgggccttcccgcgtacgggcggcccggatctggcgcgcacggcgaaggcctcgtcgtccggcgacgagacccccgacttccccgcgtcggcggcctccgacggcgatccggagacccggtggtcctcgccggtggaggacggggcctggtggggggccgagctgccgaagccggtgcgcctgggccaggtggtgctgaactggcaggacgcgtacgcctcccgctaccgcatacaggtctccgccgacggccgcgtctggcgtaccgccgcgacggtgacggagggccggggcggacgcgagtcggtccggatggacgcgaaggacacccgcttcatccgggtgcagggcgagcgccgggcgacggagtacggctactcgctctggtcggtggaggcgtacgcggtcgcggacgactgagccgtacggcaggcccgggagagcggcggaccctggggagtgtccgcaaagtatcgtcgtccgccctctgtcgcgggccggacgagactttccggacacgacctaggcggacacgccgtcgatccgggccatcacgtcgtccgcgccgaacggttgcagatacggcagccagcgcgggtcgcggtgtccggtcccgatgatccgccaggccaggc

SEQ ID NO: 4636 - DNA, 472 bp, Unknown
  Kingdom: Bacteria, Phylum: Actinobacteria, Class: Actinobacteria, Order: Streptomycetales, Family: Streptomycetaceae, Genus: Streptomyces
atgggcggcatgcgggccctggagtgggcggtgagcaggcccggacgcaccggttcgctgctcgtgctcgccgccccggcggccgcgtccgccgagcagatcgcctggggatcggtgcagatcggcgcgatccgctccgacccgggatggcgtggcggcgactaccaccgggcgccgccgggcggcggcccccaccggggcctcggtcaggcgcgccgcatcgcccacatcacgtaccgcggcgaacccgagctgaactcccgcttcggcggccgggcgcagcccggggagcagccgggccacggcggccgctaccaagtggagtcctacctcgaccaccacgcggacaagctggtgcgccgcttcgacgcgggcagctatgtgacgctcaccgaggcgatgaacggccacgacgtcggccggggccggggcgggatcgcccgcgcgctgcgccgggcggacatgcccgctc

SEQ ID NO: 4637 - DNA, 511 bp, Unknown
  Kingdom: Bacteria, Phylum: Actinobacteria, Class: Actinobacteria, Order: Streptomycetales, Family: Streptomycetaceae, Genus: Streptomyces
gcgcgccgcccccgcccggctgcgcggcgcccagcgcatccgcgcggaggagcgatgagcatccggcgtcgggcgaccgcttcgcgtcgaacgacgccgggcggcaggggagccgtgcggtgagcaaaccggccgcaccgctgaaggggcgggccgcgcggctcgcccggctgatgccgtccaccgggcccagcaccgcggcccgcacccccttcgtgctgctggtggtcctgctcctgggcggcgggctcatcaccctgctcctgctgaactccgcgctcaacgagggatcgttcaggctcagcgagctgaagcgggacaccaccgagctcaccgacgagcagcaggcgctccagcgcgacgtcgacagccgttcccagcccgacgccctggaacgccgcgcccgggagctgggcatggtccccggcggcagtcccgctttcctggacccggacggcacggtccgcggcgaccccaccgaggccaccgccccgccgccgtcgccgagccc

SEQ ID NO: 4638 - DNA, 656 bp, Unknown
  Kingdom: Bacteria, Phylum: Actinobacteria, Class: Actinobacteria, Order: Streptomycetales, Family: Streptomycetaceae, Genus: Streptomyces
  misc_feature (131)..(272): n is a, c, g, or t
tccggggcgcgccccggaagttcggcccaccgcacgctggtctcctacgtacggccggggcggctgctcggtctcttcggacggctcgccggacccgtcagcggacccgagctgacccggggcagcgggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccgacctcagcgcgggccgcggccactacctcggagctgatgcctcccgcaaggtgaccggccgcgtccgcaaccacccgatggcgctgtaccgggtggagcgcaccctgatggtgcgcaaggccggtcagccggcctccgccgccctgccggtccgggtggtcagcctcgactggtactccacccaggacgcgcgccgcctcgcgggctgggacagccgcacgcccggagcgaccggcccgaacccggacgccgagccgccggtgccgtggtacctcacccgtcaggacccggtgcacctgggcggccaagtccgcgccgagggattcgtaccggaccggcggccccccgcgccggccaccacgccgacggtccccgcagcgg

SEQ ID NO: 4639 - DNA, 1426 bp, Unknown
  Kingdom: Bacteria, Phylum: Actinobacteria, Class: Actinobacteria, Order: Streptomycetales, Family: Streptomycetaceae, Genus: Streptomyces
ccggggccagggctcccagggccagtgccatggcggccggggcccacgcgccgtccagacgtccggcggacgccgcgtgggcggcggccgccacgaccccgatgacggcggcgacgaccagcaggccgcgggtcgcgcccgcaccggtctcccaggactgttcggcgcgctgggcgcgggcgagcccgcgtccggcggaccgcagccgggcacgcctgcggttcagtgcccccgccatcaggagttcgcgcagcccgtcgacgctctccacggtctcggacgagacctcggcgagcgcgctccgggtccgcgccccgcgttcggcacgtccgcgcgcttcgaacagcggtgaccagatcaggaggagcgcggcgggcacgacggcgagcagcagccaggggccgagggccgccagcacagcggccgacaccgcgaagaccacgccggaggcaaggagttgggcgatggcgtgggcgtagaagaattccagtgcctcgacgtccccgagcgcggtggccgcgaggtcgccgctgcgccggccagcgatccgggcgggggcactgcgggccagcccgtcgaagacccggacgcgcagttcggccaggacccggtaggcgaggtcgtgcgagaggtccatctcccgccaggtggcgagggcccggagcaggacgagcccgatcaggacggcgacggtcccggcggtgggcgggcggtgctccgtgacggctgtgccaaccgtgtacgcggcgagggtcacgagggcgaccagggccgcctggtcgacgagggcggccaggcaggtgcgcagcacggtggcgcggtgcgcgccgaggaccgggaggagcgagcgcagggcgccggtcccggcctcgtcggtggcggcggggcccggcccggaggggtgaccggggtcggtcgggacagagatcggggtcatgcggcgcgctcctcctgtgcggtgcgcccggccgcgatgagcgaggcgtacacgccgccgcccgcgagcagggtggtgtggtcgcccgtcgcggcgacacggcccgcgtcgaggacgacgatgtggtcggcgtggcgtacggcgtcgagccggtgggcgacgacgacgcacgtacggccccggccggccgccgacagttcccggacgatgcgggcctggccgcgttcgtcgaccgcgctggtggcctcgtccaggatcaggaccggggcgtcggccagcaacgccctggcgagggcgagccgttggcgctggccgccggagagcgtggcgccgcgctcgcccacgagggtggcgtaaccgtccggcagccgggcgatctcctggtcgatcccggcggtgcgggcggcggcgcgcagttgttcgtcggtggcggccgggcgggcgatccgcaggttctccgcgatcgtggcgtggaagaggtaggtgtcc

SEQ ID NO: 4640 - DNA, 867 bp, Unknown
  Kingdom: Bacteria, Phylum: Actinobacteria, Class: Actinobacteria, Order: Streptomycetales, Family: Streptomycetaceae, Genus: Streptomyces
cgggccgccagcgtctgggggtggtcggggcccagcacccgggcgcgcgcctcggcgacctcccggtacgccaccagggcctcgctccaccggccgagccagccgagccccgcggcgacctcccggcggctgatcaccgtgtccgggtgatcgggtcccagcgtgcgttcccggagcgcgcagacctcgcgcgcctccgcgagcgcctcttcccagcggcccgtccgccccaggttgaccccgaggccgtggcgggcgcgcagcgtctcggggtcggcggcgcccgcggtcctggtgcggtcggcgaccagggaccggtacagctccagggcctccgcgtcgcggccgagccggccgaggctgatgccggcctcgtagcgggcggcgaaggtgtcggggtgatcggccccgagggtgcccgcacgggcccgggcgacgtcctggaaggtctccagcgcctccgcccagcgacccagcctgcccagggtgtacgccacctcgtagcgggtcgtgagggtgtcggggtgcgtcgggccgagcagccgggcgcgggcgtcggcgacctcccgggccagctgccaggactcctcgggccgccccagcctgctgaggttgaccgccaggttgtggcggcagcgcagggtgtcggggtgctcggggcccatgacgcgttcacggacggcgagaaccgtctcgtacacctggtgggcctcggcgtgccggccgagccgacccagcgcgtgggcggtcgcctggcgggcggcgagcgtctgcggatggtcggcgcccagggcgcgttcgcggccctcggcgacccgggcgaactcgcgcagcccttcctcggcgcggcccgtacggctgagggtg

SEQ ID NO: 4641 - DNA, 726 bp, Unknown
  Kingdom: Bacteria, Phylum: Actinobacteria, Class: Actinobacteria, Order: Streptomycetales, Family: Streptomycetaceae, Genus: Streptomyces
cggcgtggccgcaccagcagcacgaggccgcccagcagcccgcccgcggcggcccccacggcggcgcccagcggcaccgaaggcgagaccggctggtccggcgtcatcgcatgggtgaacttgatcagcttcaccccggtgtccttggagacatggccgctgctcacgatgacggcctcgatgaccgcgttggcgatgtcggccgccctgtgccggtcctcggacgtgcccgtcaccgcgatcatcggcgagtcgggagaggtctccgaccggacgtgggaccgcagttcgcgcaccggctcgcccgccgcgccctgggcgtacgagagcgtcgcgtcgctggtcgtcagccgcccgtacgactgggcgtaccccagggccgccgaggggtccgtctccgcctccgcgaccgccatcgcatagctggtggcctcgtaccggtccgcggcgagcgcactgtacgagagcccggacgcggtgccgatcagcacggagacgggcagcggccaccagtgcggcagccgggcgagggcggtacgcagccgacggacgacgacgtgtcgctgctgctcgggtgagtcggtcatgaatgggctctccggttcggtggggcggtgtcgagggcgtacgcgtacacgtccatcaggcgctcgctgctgcgcctgatgtcgtaatggccgacggcccggggcggcggccgccggtccgttccggcctgtatccgct

SEQ ID NO: 4642 - DNA, 729 bp, Unknown
  Kingdom: Bacteria, Phylum: Actinobacteria, Class: Actinobacteria, Order: Streptomycetales, Family: Streptomycetaceae, Genus: Streptomyces
gtgtgggggccgggggaacccgtcccccattgcggccgagctgtgacatcccctaggggccgtacccccggccccgggagggggagttcaggggaggaacagcgtcgtggagaaggtgaggaccggctcgtccgtgttacccgccgggtagagggcgatcagatcctgccgctcgccccggtacgtccgcaccaccgtgtccggcttcttgtcggcgtcgtagtcgccgtggtccaggagagtggtgcgggtggtccccgtagcgtccaacggcgcgccggggagcttctccgaggcgaacgcgtacgtgccgcccgggcgggccgggcccttcgcggagccgaggaggagggtgcccttggccgcctggccgggggcgtgcgggcgggcggcggcgacgaggtcgtcgtaaccgtccccgttggcgtcggccctgggctcgggggcgtagaggtacgggccgccgtcggggagcagttccgcgccgcgcggggtcccggtgcgggtgaaggggccgtgcaggaaggtgacctggccggcgctggcggtgaccgcgaggtcggccttgccgtcgccgccgaagtcgccgcagaccggctgctcgggccactcgttgccgaaccgggcctgcgccgggatgcttacggtgaccgccttgcccgtcaggccccgcggagagccgaagaggacctggagggggacgggcggggcgccgatgccgttgtacgg

SEQ ID NO: 4643 - DNA, 1061 bp, Unknown
  Kingdom: Bacteria, Phylum: Actinobacteria, Class: Actinobacteria, Order: Streptomycetales, Family: Streptomycetaceae, Genus: Streptomyces
aaggtgtactccgcgtcggagagggccgcgcgccccgcgaaccggagggcgagaccgcccagccacgccggatcgcggtccttgagcgaagcgaggatcagcgggtagggcgagcgggtccagtcgcgcagatcgcggccaccgatccaggaggcacaccccgccgccccggtgtgacagcccgcgccggccaccagcagagccttgcggatcttgtcccgccgctgccagtcccagctccgcacctccttgcgcagctccttcagctcggcgagggcggcacggcggccgggcaggtccagaccgagcaccagcggcggtacgtcgtggtgacgccccgcgtggacggcggtgagcagctcgttcatcgcacgcctccggcgaccgtcgcaccccgacggaccatgcgcaccgcgagcgcgtgtttgcagggccctcgccgcccccggtagtccgcccaccactggcaggtgcacgagaacgaggaaccgctctcgcgcacctggtagcggcggtccccggaggcgaccgtcgcccgcgcaccgtcgagggacaccgcgccctcagcggccagcctgcgggcagccacgagacgcggattgtgccgctccgcccggtccgcgtcgtacggcagctcccggtggaagtacgcggcgtccgccaggtcgtagccgacccggcccgccgtgccgagccgggtcagcgcggcgcgcacccgctccacgtccaggcccgaccgctcggccagtgaccccggttcgatccggggctcccagacgagcagcacggacaccaactcggcatcggccgccgcgtcatccgtggccagcgcctccaggacgccgccctcgcccgagaatccccgcgaggagtcgggggagagcgtcagcgtgagccgcatccccggcagcaccacctcccaggcactcgccgccgccgcgccgtcggccaccggcccgtacacccgcagggccgtcgcgtcgcgcaacacccgctgcaacgccaccagccgctcggggcccgggaggcacaccgcgcccgacgacccggccggtcccggg

SEQ ID NO: 4644 - DNA, 628 bp, Unknown
  Kingdom: Bacteria, Phylum: Actinobacteria, Class: Actinobacteria, Order: Streptomycetales, Family: Streptomycetaceae, Genus: Streptomyces
acttcgatgccgcctccgccgcccccctgcaccccgtcgcacgccaggcgctgcttgccgcgctcgatgagggctgggccgatcccgcccgcctgtaccgggaggggcggcgggcccggctgctcctggacgcggcccgggaggccgccgcggaggccgtcggatgccgcccggacgaactggtcttcacctcgtcggggacgacggcggtgcacgcgggaattgccggggctctttcgggacgtcggcgtgtcggccgccatctggccctgtcggcggtcgaacactcgtcggtgctccattcggcggcagcccacgaggcgacgggcggctcgttcaccgaggtcccggtggaccgcacgggggcggtggatccggcggtgtacggcggggtgctgcgggcggacaccgcgctggcctgcctccagtcggccaaccacgaggtgggcaccgagcagccggtggcggaggtcgccgcgctctgcgcggaggccggggtgccgctgctggtggacgcggcccagtcgctcggctgggggccggtcccgggggcctggtcgctgctgacggcgagcgcgcacaagtggggcggcccggccggggtcgggctgctcgcggtccgcaaggg

SEQ ID NO: 4645 - DNA, 837 bp, Unknown
  Kingdom: Bacteria, Phylum: Actinobacteria, Class: Actinobacteria, Order: Streptomycetales, Family: Streptomycetaceae, Genus: Streptomyces
ggggtacgcggtacggcgtccaggacggcgaagtcgccgcgcccgtgtccttggcaccgagcgcggcgacttcgccgtcctggacgccgtaccgcgtacccccgcacgggccaccgccctgctgctgcccggatacaccggcagcaaggaggacttcatcgcgctgctggaaccgctgtccgcggcgggctaccgggtggtcgccgtggacggccgggggcagtacgaatcgaaggggacggaccgtcaggagagttacgcccagggcgagttggcacgcgacgtgctggcccaggcggctgccctgggcggcggggacggcaggctgcatctgctcgggcactcgctcggcggtcagatcgcccgcgccgccgtcctgctggacgccgccccgttccgctcgctgacgctgatgtcctccgggccggcggaggtcgtcgcggcccagcaggacaaggtgaagatgctgagcgacgcgttggccgtgctgtccatggacgaggtctggcaggcgatgcaggcgctggatcccccgcaggacgcggacaccggcgacggtgcggacatgcgccaccgctggctcgcccaccacccggcccagttgatcgccaccggggcccagctggccgccgaaccggaccgggtggacgagctggccgccgtcgggctgcccgtccacgtcctgtccggggagcgcgacgacgtctggccggtggagctgttcgactccatggcgcggcgtctcggcgcccgccgcaccacgatcgccggcgccgagcactcccccaacaccgcccgcccgcaggagaccgcgaaggcgctggcggcgttctggga

SEQ ID NO: 4646 - DNA, 498 bp, Unknown
  Kingdom: Bacteria, Phylum: Actinobacteria, Class: Actinobacteria, Order: Streptomycetales, Family: Streptomycetaceae, Genus: Streptomyces
gccctgccggacctcgtacggcagcggtccgacggtgagcaggctctccagggcgtagccgatccgggggacggcggcgagccagggtccgaagagcgccgggtacgcggccgagcgccacgggtcgtccgcacccgttatgcccttcagggcggagtggccggccagtcggtggacgacgtcggtgcggaggcgggcgtagagggtcgcgtcggtgctgtccgcgtccatgtggcggtcccagcgcagcagccggtcccggaggcgttcggcggccgggccgaggccgggggcccgggccagcaaggacagcaggggtcgggacgaggcgaggcgggtgtcggtgtggacgccggccatggcggcgggcgaccagtccgtacgcgcgcccagcagctcccgtatccggcgggcccggtgcggtggcgcgaactccacgccgagtggggcggcgaggccgcgctcgttggccatcacggcgatcccgccgggcccgac

SEQ ID NO: 4647 - DNA, 741 bp, Unknown
  Kingdom: Bacteria, Phylum: Actinobacteria, Class: Actinobacteria, Order: Streptomycetales, Family: Streptomycetaceae, Genus: Streptomyces
ctcctcggcggactggaggccgaacacggcctgcgcgccctgctgacggcgatgcccggcatccgctgggccgacggcttccgcccggcggcgggtggcctgctcacccggggcccgcgcaccctcctcgtacggccgtcctgacggtcagcgccccggcctctcagtcccgcacccgccgcagcagcgccaccggccgctcggcgaacagctcggccgccgccaccgcaccgcccgtgaactcccggtccggcgacgccgacagcaggtcccgccagaggcccccgtccggcagctccagcaccgtgtcccgccagcccccgctcgcggccagccgcagcgacagccgggtcaccgccgtgagcacctcgcccgaccggcagaaggacagcaggtgcgaggcggccggaccccgggccgtcagcggcgcgtacgtccccgactccccgaacacgtccggcagctcccgccgcagcagcagcgcggtcgccgtcagcgcctgcttctcgtccgggacctccggccgccggaacggccgccggttgtcggggtcgaccagagccaggtacgcgctctccgtgccctggtagaggtccggcacccccggcatcgtcagatgcaccagcgcggcccccagcacctgggcccgcacatgcggggcgagcgcgtcggcgaactcggcgaccggcgcccgggcagtacccgccccgctgcccggaccggcggcgacgaagtccgtca

SEQ ID NO: 4648 - DNA, 915 bp, Unknown
  Kingdom: Bacteria, Phylum: Actinobacteria, Class: Actinobacteria, Order: Streptomycetales, Family: Streptomycetaceae, Genus: Streptomyces
cgcgaagtccccgaacggccggggcggacgcccggtcagttcccgcagggccccggtgaccgtctcggcctccccggccgcgtaggtcgcgtacagctggagccgggcggccaccgcccaggccgggacacccgctccgagcatcgcctcgcgcgcctcgtcctcggagacgtccaggtagcggatctcccgcccggaggccgccgccagttccccggcggcctccgcgtagtccagggcccggggacccgtcagctcgtgcacctcgccgcggcccggcgggccggtgagcagggtcgccgcggccgccgcgatgtcccggacgtcgaccatgctcacgcgggcccgcccgacggggagcagcacggccccccgggacgcgatggtgccgagccactgggcggcgttctgcgtgaacgcgttgggacgcaggacggtgtgtccgggacaccggtcggccagggcctgttcggccaggccgtgctggcggtggacgagcaccggtgagtccgggtccgcgcccagggccgacagcttgaccacgtgggcgatcccggcggccgccgccgcctcgatgacggtccgctggagcaggtcctgccgggggtggaagggggtcagcaggaacagggcccgggtgccggtcagcgccccggccagccgccgcacggcctccggaccgccgtcgcccagatccgcctcgaccggatcggccggccctgccaccaccccgccccggcccggccggacgagcgcgaggggccggtgaccacgcgccgccagctcccgtacgagggcggtgccgagggttccggttgcgccggtcaccgcgatccggccggtgggagcggccgtcacggtgcgaccagagccccggccccggcgtccgccagccggtcgggcagccggtcctcc

SEQ ID NO: 4649 - DNA, 604 bp, Unknown
  Kingdom: Bacteria, Phylum: Actinobacteria, Class: Actinobacteria, Order: Streptomycetales, Family: Streptomycetaceae, Genus: Streptomyces
cgtcgggcccgagccgctccagcagctcccccgcggtgaccccggcggggacgggccggatcccggtgagcggtacgggaggcgtcccgtgcgcgtcgacggtgacgccgaggcgggcccagtcggggtcggccgcctcctcgcagctgacccggacccgggcgccctgggcgacgacgagccggcgcacggcatgggcggtgacggcggcgcggacctcccgcgcgtggtggaactggaggatctcctcccggagcgcgtccccgtgtccgtacgcgaggccctgttcccgtacggcgtcgagcacggcccggtcgctcgcggccggggcgtcgagggtgaagctcaggaaccccggtccggtgatctcgacccgcccgacgccgggctcggcggcgacgcgttcgcgcaggatggccgcgacctccagggcgggcagcgcggcgggcccggcggcagcggggactacgccggcgccgtcgcaccccagctcgccgggccgggtcctctccacccgcacgcgcgcgggcacgggtgcgcgcaacgcattctcgtcgaccgtgctgcacttgtctcttaaacacatctccgagcccacgagacc

SEQ ID NO: 4650 - DNA, 660 bp, Unknown
  Kingdom: Bacteria, Phylum: Actinobacteria, Class: Actinobacteria, Order: Streptomycetales, Family: Streptomycetaceae, Genus: Streptomyces
gcctacgagcgcgtcgcgggccgctttccggaccgccggcttcgcgtggtcgaggagccggacgagatcgggcagcgcgggctcccaggcggcgcggccgagcgtccgcgccgccatgcgcaccacgtccggcaagggatcggacagcaggagagcggtgagccgggcatgggtgccccggtcgaacagggcacgcgaggcgcggtgtgcgtgcagacgcaccccggcacgcgggtggcgcagcaactcctcgaccagagcgtgcagttccgggtccggatcggctccgcgcgcgggagcgcgctcctggacgaggcgggtgagggcctggcgggtccgctcgggcgttcccgtgcgggcgaggtcgagcagttccgccggcgacggacggtccgcaggggtcgccggggtccggaacggggtgcgcagggcgtcgagcgcggcagcgtcctcgtgttcggccccgggtgtgcgcaaggggccgtcgacgaggacgagcgcgtcggccagggcatcgcggccttcggtacgcagccgacgcccggccctggtcagtgcgggtgtccggagcagctccacgccggtcaacaggtcgagcagtccgagctcgcccgcctcgacgcgtggcgcgaggacgtgggcgaggacatcggcgggaac

SEQ ID NO: 4651 - DNA, 786 bp, Unknown
  Kingdom: Bacteria, Phylum: Actinobacteria, Class: Actinobacteria, Order: Streptomycetales, Family: Streptomycetaceae, Genus: Streptomyces
cgtccgtgccgggcgcccggatcagctcgtccgcccgatcggcgtggcaggtgaagaagcccagcgcctccaggtcgtcggtgtccggggcggtgccgaagccggtccgctccaggccctggcggaagaagcgctgctccgccgcgtcgcacaggccggcgggccggacgtcgagcccgtcgggccccagcaggcgcaggtagcgggtgatgctggtggcgcccccgagcgggacgaccacgacgccctcggcgctcagggtgcgcccctggcgttcggcgagggcctcgaccgtcgcccggtcgctgacgccctcgacgagcaccacggtgcgcaggctcaggtcggccgccagttcacgggcggccccggcctcggcgggcgcgcgcgtgtccccgtcacccgcggcccaggagatgaccgtctgccggaagcgcgtcgctgtgtccacggggccagtctcgcaccgtgatcggcgggtacggcaagggttttccggtacgtcggcaagggctgtccccgggtaggtcagcggggtgcgggaggtcgccgcgccagatacaggccgacgcccagggcgagcgccaggacacagccggagaaggtcagtccggcgttcctgagcccgatccccagggtgagcgcgccgacgccgaccacaggcagggagatgcccaggtaggcgatgacgaagaaggcggacacggtcgcggcccggtgctcggccggcgcggcggcgctgatcgccgtcaccgcgccgcggaacgccagcccttggccgaggcc

SEQ ID NO: 4652 - DNA, 1029 bp, Unknown
  Kingdom: Bacteria, Phylum: Actinobacteria, Class: Actinobacteria, Order: Streptomycetales, Family: Streptomycetaceae, Genus: Streptomyces
ggtcggcgacgcggcccgtgcgctgaccccgcaggtcccgtccgtccccctcatgagcaccgtcaccgccgagtggcagccggtcctcggcccggagtacctgcgtgaccacgccgagcgcccggtgctgttcggggcggccgtggaacgcctggcccgggaggggtacgacacgttcgtggaggtcggccacggcgcgaccctgtcgggtgcggtccgcgcggcgacgcgggcgtacgcggccgacgcgccggtggttcgcgccgacgcggccggaacccccggaacgacgggcgaccccggcgcgaccggtggtgcgacgacggtgatgtgcgccctgccgggtcgttccgacagccgcacggaagcggaacgtccgcccgttgacggccaaggcgggcgcggggccctgttggcgaccgtcggccgcctgtggtcgcacggcgtgccgctggaccgcaccgcgctcgacgcggagcaccaccggattccgctgcccacctaccccttccggcgtcgccggtactgggccgaaccccccacgagcgcgctgctgcaccgggtcctgtgggaggacgccgccgtgcccggagagacagcggcggccgtgcgttcggtgctgctgacagggcccgactccgcgtacgtcgaccggctcgcctcgcagctctccgccgagggcatccggatgcacgaaacgggcgacggaccgccggatgccgtggtcctggtggccgggcccgctcccggccaggacaccggcgacgcgctcgaccgggcccaggacgccgcgctggccgccttcggcgaggccctcgcacggttcgacgagacacgcgcggatcggctgctggtgctgaccgaggacgtgcacgcgacggggtccggacgggaaaggcctcgtccggcccacgccgtcctcggcgggctgctgctggcactgccgcaggagactccgggcacttcggtcagcacggcgttcaggcgctggggcggggtgtccagcgagcagaggtcgagggcggtgac

SEQ ID NO: 4653 - DNA, 546 bp, Unknown
  Kingdom: Bacteria, Phylum: Actinobacteria, Class: Actinobacteria, Order: Streptomycetales, Family: Streptomycetaceae, Genus: Streptomyces
tcgtcggggagcccggcatggtcggcaggacccctacagccagcccgcgaactccaggttgatctcgccgatctgccgccgcccctcggccagcgcgcgggtgcccgactcgaccgcccggaacagcgtccagccgtgcagccgcgcctgctccacctccagcgactccgccagcttcttgacccgtcgccgggccgtcaccggcccgccgggggaggcgatcagatcctccacccggtcccgcaccagccgcgccaggtcgtaggcgcgctcgcccaccagcggctccggacccaccgtcagccacggcgcccgctcaccggagagcaccttgctctgccggaagttgccgtgcagcagcaggagttcggacgatccttccaccagctccgcccgcgccgcgagcgccgcgtccaccagcggcgccagctccggctcggcctcggcggccgcccgcatcccggcgctctgccgatcggtccgcccggccacgctctcgaaggcatgcccggtcggcggctccacccacagccgccgcagcgtgcc

SEQ ID NO: 4654 - DNA, 558 bp, Unknown
  Kingdom: Bacteria, Phylum: Actinobacteria, Class: Actinobacteria, Order: Streptomycetales, Family: Streptomycetaceae, Genus: Streptomyces
ggagccggggtcggtgcgggcgcggccgcgggtgcgggtgcgggagccgacagcggcgcctgctgcgccggtgcctgttgtggctgcgcgtgctgtgccggtgcctgctgcgagtgctgtgcctgcgccggcagggcccggggcgtcggagccggtgcgaggctgttctgtgccgcgcccgcgttctgcgggccctgctgcgcaccggcgaacgacggtgccggggcgggctgtacggcgttggaccccgcgacacgcggtcccaccgcgcggatcgtgaccgtcccgtcggtgggcggacgctccccggcctcctcggcgggacggccgccgccctcccgcatccccggcagcgcgccgccggtcgggtcctgggccagcggcgccctcgggtcggcctgcggggatgggcggccggcgggctcctgcgccggcccgccccagtcgacccggcggtcccggtcgccgccgaaaccgttctggtgcgcggtgtccgcctgccagacggacgcggcgtccgcgtggtccgcgacgggtccggcggatccggccggggcc

SEQ ID NO: 4655 - DNA, 543 bp, Unknown
  Kingdom: Bacteria, Phylum: Actinobacteria, Class: Actinobacteria, Order: Streptomycetales, Family: Streptomycetaceae, Genus: Streptomyces
gctcggagagccggcgggccgccaccggttcggcgaggacccgctcctcccccagcaccccggcgagcagcgccgtcccgtcgtcggtctccagggtgtcgagcgggaccggccgggcggcgtccgaggcgatgagcccttccagccggtggcggctggtgaccagcgtgacgcagtcggcgccgcccggcagcagggtcctgacggtggcggagtcgcgggcgttgtccaggaccaccagcagcctgcggcgggcggtcagcgagcggaacagcgcggcggcggccggcacggactccggaacgcggcgcggggagacgccgagcgcgagcaggaactcccgcaggacgtcgatgagcgcgggttccccggccgcgctgaacccgcgcaggtcggcgaagagccgcccgtccgggaagagcgcggggttgcggtgcgcccactggagggccagcgcggtcttgccgaccccggccggcccggtgaccagacagacgggcgcctcgcccgccgccgaccggctgagcgcggccagctcggcgg

SEQ ID NO: 4656 - DNA, 519 bp, Unknown
  Kingdom: Bacteria, Phylum: Actinobacteria, Class: Actinobacteria, Order: Streptomycetales, Family: Streptomycetaceae, Genus: Streptomyces
ggcgtgggcagcgcgtgtccggcggcctcgaacgccccgaccaggcgggcgagttcggccgcgtgcgggccctcgtccggtgtcccgtcctccggtgtcccctcccccgccagccggcgcaccaggtcgtcgccggtgacaccgccggtgtcgatgcgcaggaactcccctccggaggtccggagcacgggggcgccaccgggaacggtgacgaacccggtgccgggagcaagtcgactgcgggtcacggaatcctccggagcgggaagcggggacgggacgttcgggggctgaacggggtgggcccgcccgggatgtcaccgggcgggcccacccccgcgctgcgcggggaacctgccgtcagcggcaggcgccgcttacttctcggccgcggtgtcggcctcgaccgcgtcgtcgaaggggttctcgacgagggcgttcgagtgggtggcggagaggtgggcgagctgaccctgatcggcgatcgggctgaacaccttgtcgttctccatgagttga

SEQ ID NO: 4657 - DNA, 626 bp, Unknown
  Kingdom: Bacteria, Phylum: Actinobacteria, Class: Actinobacteria, Order: Streptomycetales, Family: Streptomycetaceae, Genus: Streptomyces
tacctcgcccgcacggacgccgtcctggccgccggcagcccccgtacggcccacaccgtctacaccgcgatgcacggcgtcggcacctccgtgctgaccgccgcgttcgagcgtgccgggttccccgcaccggtcctcgtcaccgaacaggccgagcccgaccccgcgttccccaccgtggccttccccaacccggaggagcccggcgcgatggatctcgccttcgccaccgcccgccgggccgcgccggacctgatcatcgccaacgacccggacgcggaccgctgcgccgtcgccgtgcccgacaccgccgcggacggcggctggcggatgctgcgcggcgacgaggtgggcgcgctgctggccgcgcacctggtggagcggggcgtgagcggcgtgttcgccgagtcgatcgtgtcgtcgtcgctgctcggccggatcgcggagaaggcgggcctcggccacgaggagacgctgacgggcttcaagtggatcgcccgggtggacggcctgcggtacgggtacgaggaggcgctcggctactgcgtcgaccccgagggcgtccgcgacaaggacggcatcaccgccgccctcctcgtcgccgagctggcctccgcgctcaagga

SEQ ID NO: 4658 - DNA, 554 bp, Unknown
  Kingdom: Bacteria, Phylum: Actinobacteria, Class: Actinobacteria, Order: Streptomycetales, Family: Streptomycetaceae, Genus: Streptomyces
cctgcccggccccccgcctgcggcggtctccgcgtgctccaccatcaccgggcaggagcgctcctcgctcccgtcgcgggtcagcagcagcgccgtgggcctgcttccgccgaagtgtcggcccgtgagttccagcggggcaccctccgacccggcggtccggtggccctcggcccgtgcccgcaggtgcgacacggtcagccggagccggccgtcccggtagtcgagcaccgcccgccgcccgtcgcccaggtcgtggacgagcggctggtccgcgcccgcgtccggggcgcgcaccgccacccgccgcaccgctccgggtgcgccgagaaccaggccgaccagccagccgccgccgtccgccgtcgcgggcagccggtccgggtcgaggaccatctcgaagcccgcgtggtcgtagccgtgcagctcctgaccggagttcaccgtcgcctcgggcgcgtccacggaccgcaccggcaccggccgcacctgccgcccgcgctccgcccggaccatccccaccgtgagccgctgccgggcggagcgcgggcggc

SEQ ID NO: 4659 - DNA, 698 bp, Unknown
  Kingdom: Bacteria, Phylum: Actinobacteria, Class: Actinobacteria, Order: Streptomycetales, Family: Streptomycetaceae, Genus: Streptomyces
gctcggaaccctgtgcgtgcccggcgtccggcgctccggatccgtccggcacggccggggcggagcccgggtccgcgataccccggtcgcggcctgccgcgcgctcggccgaggcgtccgccccggcgtcgcccggcgacgccgcgcctccccctgccccacggccggtgtccggcacggaaggtgacggagcaccgggtgcgtccggtgaaccgccgggcacggggagcacggggagcccagagaagagcgggggaagcaccggcagggacggcatcagcggccgcgcctctccggcgacccggtccacggtgtctcccgcgcgcacgagcacggcatcgcgggcaagagcatcggcgggggcggcgggtgcggcggcgagttccgcggcagactccaccacagattccgcaaggaccttctgcgcaggggccttctgtacggtccgctgcggcggggactgtggttgtccggcctgttgccgtgtggacggttgccgtacggcccggtcgacctgcttgatcactggctcggccaccggccgggccaccggcctgacgatccgttcggcgacccgccgggccgaaggctcaactgccgtgcgggaagcggcccgggggtccgtgctctccggcgcggcgtccgccacggaggcggtgagcaggcccggttcgggtcggtcctgcgcttccgcgcgg

SEQ ID NO: 4660 - DNA, 511 bp, Unknown
  Kingdom: Bacteria, Phylum: Actinobacteria, Class: Actinobacteria, Order: Streptomycetales, Family: Streptomycetaceae, Genus: Streptomyces
ggtcgcggtgctgggcgcgctggtggagaccgtgacggggcaggccccggtacgggggccccgcaccgcccacgggaaggcgccgacgcccgtggacggcggctccgtggtgggtctgccggtgggcggcaccccggtggagggggttcctgccggcggcttcccggcggggggtgttccgcgtgccggcctcccggtgggggaggggtcgctggagtgccccgaggacggcgtcgccgggcccgcgttcgaggtgatctacctcctggaggccggtgacgagcaggtggcccggctgcgcacccggctcgacgcgctcggcgactccctggtcgtggtgggcggcgacgggctctggcacgtccatgtccatgtcgacgacgccggggccgccgtggaggcgggcgtcgaggccgggcggccgtaccgtatccggatcacccacttcgccaccgagagcggccacgacctccgcgtccaggccgaacccgcgcagcgcgccgtcgtcgtc

SEQ ID NO: 4661 - DNA, 559 bp, Unknown
  Kingdom: Bacteria, Phylum: Actinobacteria, Class: Actinobacteria, Order: Streptomycetales, Family: Streptomycetaceae, Genus: Streptomyces
gcgcgctcgccccgcccggcgccccggtcctcgtggagtcgcccacctatcccgggatgctcgccgcggcccgcgccaccgggctgcgccccgtcccggtgccgatggacgccggcggggtgcgccccgaactgctcgccgacgccttccgggccaccggcgcccgggtcttcgtcacccagccgctcttccataaccccaccggggccaccctcgcacccgcccgccgccccgagatcctggccatcgcccgcgcggccggtgccttcgtggtcgaggacgacttcgcccgccgactcgtccacgacgacgccggaccgcttccggcgccgctggccgccgacgaccccgacggcgtcgtcgtccacgtctgctcgctgaccaaggtgacctcgcccagcctgcgggtcggggccctggccgcccgagggccggtgctggagcgcctgcgggccatccaggtcgtcgacagcttcttcgtgccccggccgctccaggaggccgcgctggaactcgtcggatccccgtcctggggacgtcacctcgccgccgtcgccgc

SEQ ID NO: 4662 - DNA, 717 bp, Unknown
  Kingdom: Bacteria, Phylum: Actinobacteria, Class: Actinobacteria, Order: Streptomycetales, Family: Streptomycetaceae, Genus: Streptomyces
ttcgtactccgcgcccagcgcgtcgaacaccgccgcggcccggcgtccgcggccggcgtccgcgtccggaggctcttggccgccccgggcttccccgcggtcaccgagtccctggctgtcacccatcgaggcgatccttccgtggtgcggcggccgaccgggatccgtgtacccggccgctgtgagcgtccccccgcgagggcctgagtatgcgggtcccgaacccctgagtacgttccccgatgttccggctcccgggccgttgttcgatgaccgcatgacctccgaagcgccgcgccgcccccgcatccagcacgtgaccaccgccggttccgccctggccgtcacgctgctcccgctcgtggtcggcgcgctgctggccaagaccatggcggcggacccgatgacgtcggtgaacgcgctcgtcacccatggcgcgcaccgtccgcgggtgtcgcccaaggagtggcgccggtgcggcggccacgcgctgcggcggctgcggtccgccgaacgggcctccctcgcccgtatcggcgcgcgctgacgccgtccggccgatgaggtccggccggacggcgtggggacgggcgtccgggtcagctgaccggctggaccggcctgttcccctccggcgacggccgctcgaactgggtgcggtacagctcctcgtacctcccgccggccgcgagcagctcggtgtgcgtgccgttctcg

SEQ ID NO: 4663 - DNA, 610 bp, Unknown
  Kingdom: Bacteria, Phylum: Actinobacteria, Class: Actinobacteria, Order: Streptomycetales, Family: Streptomycetaceae, Genus: Streptomyces
cgtccgcgagccggaacagccggcgggccgagcgcaccgggccgatcgggtcgccggtcgacgcgaccccgcaggcgaccccgtcccccagctcgatcaccgccgcccggtcacacagctcggtggcgacgccgaccaccgcgttggccggggggcccgccgcgagcagacagaactcgtcgccgcccagccgggccgccagcgcctcgggcagcatcgccccgcacagcgacagcaccgagccgaaacgttccagcagacggtcgccgacggcgtggccgtgggtgtcgttcaccgccttgaggccgttcaggtcgcagacgacgaggctgacgacggtgtcgtcgacacggtgccgctcgacggcctcgtcgagccggatgtcgaccgcgcggcggttggccagaccggtgagcgggtcggtgaaggccagcttgcggacctcctcaagacgctcggtctgggcgatcccggaggccacgacggcggcgagcacggtcgcgaagttcgcgtcggcccggtcgaagacgggctgcccggccggccgcgccacatacagctcgccccacgcccggccgtgcagcacgatcggcgcgaccacgcagcagcc

SEQ ID NO: 4664 - DNA, 621 bp, Unknown
  Kingdom: Bacteria, Phylum: Actinobacteria, Class: Actinobacteria, Order: Streptomycetales, Family: Streptomycetaceae, Genus: Streptomyces
gggcgatgtccgtcgtggcgcccgggacgatggcggcgggcgcgggctgcgggtcggcgacggtgcgcccgtccgcgaagccggagacggcgaggacgacgaccgggatatcggtgagcgggttgaccgtccaactggcgcgctgcccgtcgccgaaggaggccgcggtcgtgtcctcgggagcgtacgtacggggcatgaggtccttgcgcgcgccgagcttctgctcggtgaaccgggtccgcagggcccgcatgcccggggcgtccgcctcggtgaagaccaggccgacggtggtgacggcggagcgggtggcgtcggtgtaggtggcgcgcaccagccgttcgcagccgacggagcggagcgtggtcaggagcagcgggtcgagtccgcccttgcaggtgctgtcggcggcgacggcgatccggttccaggtgcggtgggtgccgccgggccccgcgcccttgccctggagagtgcgcgggaacagcgtgtcgaccgggacgctgtgccaggcactgcgtgcggcggtgtacgggttccgggtggtctcggccgaggagtcgccggtcagccaggctccggtggccgccccgccgatcagcccgaggccgagcacga

SEQ ID NO: 4665 - DNA, 538 bp, Unknown
  Kingdom: Bacteria, Phylum: Actinobacteria, Class: Actinobacteria, Order: Streptomycetales, Family: Streptomycetaceae, Genus: Streptomyces
ctgatcggcagcggcagccggcgcggcaagctcatcgtcccgggcaaggcgctcgccgccctcccgggcgccgtcctcgtcgacggcctcggcgtctgagccaccctccgcgggtgcctcaactccccgtcgggcgaccggatcggcgctccgcggcgcggtgctccgtgagccagtccgtggcgaagtcgacggcggggcgcagccggacgagcctgcagtcggccgcgcccacgcgtccctcgcgtacgtcaccgtcggcggcggcaccctcgaacgccgcgcccagggcggcgaagtccccgtcgtccagggcgacatcctcgtactcccaccaccggcgcacccccagcgacgccaccacacagcggtaactccggcgcggcggaccgggcacccggtactcgcccaggtggaacgccgtacacgtggcgtagccggtgccgagcagcagaatccgggcgtccgcctcgtacagccgggccagcggcgagtcctccccgagatgacagtcggcccggacgcggcgcgcctgctc

SEQ ID NO: 4666 - DNA, 625 bp, Unknown
  Kingdom: Bacteria, Phylum: Actinobacteria, Class: Actinobacteria, Order: Streptomycetales, Family: Streptomycetaceae, Genus: Streptomyces
gcgcggaggcggacgggtccgggtccggctgcggccgaaggtgcgggccggactgggtccagtggccgaggaggcgggcttccggcggggtggcgaagggcagcgggtcgccgtgggcgtccaccgtgtcggcctcgcggcgcaccggggtgtgcgagatcagctccaggtaaatgccgcgaaatgccgcgaggttctgttcgacggtgaagagttcgagcgcgcgggcccttgcggcggcacccaggcgtgctcgacgctcggggtcgcgcagcagcgcgacgcaggcgtcggcgagcgccttcgggttgcgcggcggcaccaccaggccggtgccgccgatgacttcgacgaccgcgcccacgtcggtggagacggtggcccggccgcagaacatggcttcgacgaggctgaccgggaagccctcgacgacgctggacagcacgatcacgccgcccgcgccgtaggcctcggcgaggtcggggacctcggggccgccgatctcctcgaaggtgaccgggctgacgccctcggtgtgcgcgccggaggcctcgtccgggaacaactgggcggccagggcctcgcagtgggcgaggtacgtggtggcctcctcgccttccgccgg

SEQ ID NO: 4667 - DNA, 581 bp, Unknown
  Kingdom: Bacteria, Phylum: Actinobacteria, Class: Actinobacteria, Order: Streptomycetales, Family: Streptomycetaceae, Genus: Streptomyces
gcccctgcggcccccgtctgtccggaaccgacggagaatcgttccgcgccgcagatccagctgatcccggccccggcggccggcgcgctcgacgcggccgaggaagccgtcgacctgctgctggagtcgggtcgtgcacccggcgacatcctggtgctcaccaccggcgaacagcacccgtgggccgcccacgagctgtccttcggcgaagccgcctactgggcccagcacgacgcgggcgacgacgtcttcttcgccgacgtctccgcggcggaccgggcccgatcccggcccgtggtcgtcgtcgccgtcaacgacgacgcggaccggaccgtggctcgcaccctgcccgtcgcacgtgaccgcgccgccgcgctgctgatcgtctgcggagacccgcagacgatcaactccgcactcggcgccggggtctgaacacaccccgccggtgctcccggccgcccgcacgggtgaccgggagcaccaccgcggctgtcccggccacgaccggtggtcgatcggcgtgcgctcggcgggtgaccagtgcctgtcggcaggtgccggtgcccgctcagcgggcc

SEQ ID NO: 4668 - DNA, 890 bp, Unknown
  Kingdom: Bacteria, Phylum: Actinobacteria, Class: Actinobacteria, Order: Streptomycetales, Family: Streptomycetaceae, Genus: Streptomyces
agccgggaccgggcggacagccgaagcccggccggcagccgcggcacggaccgggccggccaccggtgttccgtcagccaccgcccgagcgtcttccgtctctccccggccttcccgctcttcccacgcaccagaacccccaccgtccgtcagcccgaccgcccaccgcgccaggtgcgcgcgggcgtgttgcgaaagccccgcctgctcgggacggacggcgctactttcgcaaccaccctcgcgagccgtgtgcccccaccccacctgacgaccgggacgccgcaaaggttcgccggccgccccggttgtggcgtccgacaccggcgggggagcggaccgcgcgggcgtacgcacaccgccgccgaccccaccgtgaggcggcggaaaacgcctgtgaccctcgcgcaacggcccggcaaccttcccccggcaccatcggtgcatgacggagcaggtccccgaacagcctcaccggtcgcccccgatgccggacagcaccgcgcaactcctcgcccgtatcaccgaccggctcggcgcccagctcagcctcgtctcccggaacggagcccgcagacccatgcaccgcacccggcagcccgaccgccccgcggacgacggcggcacatgcgccccgtccctggtcgccgtggcgcacggcagccgcgacccggaggccctgcgcaccgtgctggccctcctcgacctggtgcgcgacctgcgccccggcctcgacgtccggctcggccacatcgagctgaaccggccgctgctcccggacaccctggacggcctgcgcggggccgacgccgtcctcgtgccgctgctcctggggcgcggccaccacgtcaagcgcgacctgcccgccagggcggccgccgcccccgagg

SEQ ID NO: 4669 - DNA, 641 bp, Unknown
  Kingdom: Bacteria, Phylum: Actinobacteria, Class: Actinobacteria, Order: Streptomycetales, Family: Streptomycetaceae, Genus: Streptomyces
gacggtgacccggtcgccgacccgcgtggtcagccactcctcgttgacgacgatcgcgccgtcgtcgaggtcggagagccggcccgccgtcacgggcagctccgacacggcggccagcccggcggggtcgaccgcgcgggcctcggaggtcacgagggccgtgtcctcttcgaggacggtgacggccgtggaccgcgagacgctgaccacggccccctcgacggcccgtgcccgctccacgaaggcgggcgtcagcggccggccctcctgtcccgacgtcaccacgaagtcggcggccgtggccgtgcgcgcctcggtggccctggcctcctccagggtggcgacggttcccgtcagggtggcggcgagggcgacggtgatgaggacgggcgcggcgacggccgcggtcctgcgcaccccggcggcggtgttctcgcggacgaggacgccggtggcgccgggcagccgggcgggcagccaggtcagcagccggccgacgggtcgcaccaggacgggggccaggagcgcgaagccgaccacgaggagcatgggccgggtgatgtaggacttgcggcccagcagatcgccggggtcgacggccaacgccactgcgggcaggcccagtccggcgagcagggcca

SEQ ID NO: 4670 - DNA, 739 bp, Unknown
  Kingdom: Bacteria, Phylum: Actinobacteria, Class: Actinobacteria, Order: Streptomycetales, Family: Streptomycetaceae, Genus: Streptomyces
gatggtgtggccgagcatccagtgcaccgggcgctggccgctgaggaccgcgagcaggcgctcggcgaaccactggtgcgggcgttgcggccggtggggctgctgcctgcgggaccgctgcggaggtaccgaccggggaccaccctggtcgcgtcggcctgcgggcctcgtcctgtccgtgctcatgatcgtcgcccccgttgaccgggcccggcttctaccggacggtaacttgtgttggggatcttctacgggtgcggtcgtcagcgacgcaagcggcctccgggcgccgatcgggcgtgggcggattcacctatccgtggctcggaccttgcgggacaagggtgacagcgggggtgacgggtcgtcggccgtggacggacgaccccggttgccgaaacccgaaaggggacgttcccacgtatcctgaggacgtttccctctacgaaagcgacctgccatgcgcgtgtacgtccccctgaccctctccggtctcgcagcggcgcacggtgcgggcgaggtcggccccggaccgctgaccgcctacgcggtgacccccgggctgcgcgagtggtacgtctccgacgacatcgaggagctggagtacgcggcgctcaaccgggcagccgccgcctcgctccggatgatcgcggggaagccggacgaggtgcgccgccgggtcgtcgtggccgtcgacgtaccggatggggccgccgtcgccgaccccgaccacgggctg

SEQ ID NO: 4671 - DNA, 520 bp, Unknown
  Kingdom: Bacteria, Phylum: Actinobacteria, Class: Actinobacteria, Order: Streptomycetales, Family: Streptomycetaceae, Genus: Streptomyces
acccgggggcgagcgcggcggtgaccgtgccgaggccgaccgcaccgaccagcacgccgaacccgaccacgccccagccccggtcgtcggcgagcagcagggtgccgacgttgaacgcgccgggacagcccaactcgatcaggacggtgcagatcagcgcggcccggacacccggcagggccagcgcctcgccggccttcggggagtcggcgccgggcggtcccggcattcccgtgcccggcccgtgcccaggcccgggcgcctcggcgccgtcggacgggcgcgggcgcagggagaggaagagagccgcggagaccaggaaaaccagggcgccgacgagcagtccggtggacaggcccagcagtgcgcccaggcccgcgagcggaccgccgaggacgacggtggcccggaacagcgtggtgcgcagcgcctccatccgctgtcggcccgccggatcggcgatcagggcgggcaccgagcccgccgccggttcggtcacggcctcgacgagtccgaacag

SEQ ID NO: 4672 - DNA, 753 bp, Unknown
  Kingdom: Bacteria, Phylum: Actinobacteria, Class: Actinobacteria, Order: Streptomycetales, Family: Streptomycetaceae, Genus: Streptomyces
gccatccggctggcggcggtacggacggggatggagcaggcgtccgtcaccgacggcccggccgcgctcgtgcggacgatgctcggcgccgccccctccgacttcgccgccgtaccgctgcgggagtgggcggacgcctgttccctggtcgcgctccggatccacgggcggctcgacaccccggacggggacacgacgccggacgaggagcacctgctcaaggcagcccgcagtggtgaaccggccgccgtggggccgctggtcgccggggagctggaacggcaggtccgcatcctggagatcctggcggagaccaccggcacggcgggcagcggcgccggactccgcaaggcactggacctgtccacggagggccgccgggtcctgcgcgcggtgatgtcacgacgggcccgcggccgggcctgaccagcggctcagggggaggcggtcgaggcgagcgccgctcagcggttccgctccccggccacgggcggcaagggccaggaacggccctgcacggcggcgagttcggcttcgagcgggttcggggggaccgcgagaacgggacagaccgcgtgtgccggggaacggaaccgctgagcggcgctcgcctcgaccgcctccccctgagccgctggtcaggcccggccgcgggcccgtcgtgacatcaccgcgcgcaggacccggcggccccccgtggacaggtccagtgcctttcggagtccggcgccgccgcccgccgtgccggtggtc

SEQ ID NO: 4673 - DNA, 639 bp, Unknown
  Kingdom: Bacteria, Phylum: Actinobacteria, Class: Actinobacteria, Order: Streptomycetales, Family: Streptomycetaceae, Genus: Streptomyces
gtgcggagccgggccgccgcccgcgggtcgcggccgggctcctgggcggcgtggcgcagggccgtggagagcgcggcgaagaagccgttgccccggcccgccggagcgccctgggtgtaggtggcgccgtcgggtgcggtgagaagtccgtcgcggtccaggcggtagcgcgggccgtcggcgtcggcgggcggcagccagggcggggtggcgtggctgcggtgggcgggcggcttcggcgtggtctccgtgctgctgccggtggccggtcccgtaccggtggtcttcgcgcccgggaccgtcccggcggttgtcgtgccggtgcccgtgctggtcgccggcggagcgggcagcgcggtggtgaggggcggcgtcgtgccgggcggcagcgcggcggcgaagaagccgtccgcggcgaacagcaccgggcccgaggccgcgtcggccgtcgccgggtcggcgccgtgcgggaggaacagctgccggcgtccctcccccgtcaccaccgtcaccggggtgcccaggacccgtgccgcgagtgcgggcagcacgtccgcgccaccgtgatcgcccgcccggcgctcgggcggggccgggtctccggcgtccggggtctccgtcgtgggctcggccgtgaac

SEQ ID NO: 4674 - DNA, 759 bp, Unknown
  Kingdom: Bacteria, Phylum: Actinobacteria, Class: Actinobacteria, Order: Streptomycetales, Family: Streptomycetaceae, Genus: Streptomyces
gtcgagggcgccgcgcagcgcgccgccctcgaccacgccgccgccctcgggatcggcagcgtgcacgagtgcggcgggcccgagatctccgacgaggaggacttcacctccctcctcgccctcgccgccgagcggccgggaccgcgcgtcctcggcctctgggccgaggagatcgccgacgagaatgacgcccggcgcatccgcgagctgggcgcgatcggcgcggccggcgacctgttcgtcgacggctccctcggctcgcacaccgcctgcctgcaccggccctacgcggacgacccgcacaccggcaccgcccatctggacgccgcccggatcgccgcccatgtcaccgcctgcaccgaggcgggcctccaggcgggcttccacgccatcggcgacgccgccgtcaccgccgtggtcgacgggatcagggccgccgccgggacgctcggcctcgaccggatccgggccgcccgtcaccgcgtcgaacacgccgagatgctcacccccgagacgatcgccgccttcgcggaactgggactcaccgcctccgtccagcccgccttcgacgccgcatggggcggcccggaggggatgtacgccgagcgcctcggcgcggagcgggccgccaccctcaacccgtacgcggcgctgctgcgcgccggagtgccgctggcgttcggctccgacagcccggtcactccgctcgatccctggggcaccgtgcgggccgccgcccaccaccgcaccccggaacac

SEQ ID NO: 4675 - DNA, 672 bp, Unknown
  Kingdom: Bacteria, Phylum: Actinobacteria, Class: Actinobacteria, Order: Streptomycetales, Family: Streptomycetaceae, Genus: Streptomyces
gttgagtgcggcgtgcaggaggggtgggccggcggtgcggaggtagccgccggtgagcgcgatgaccaggagccggacggggtcagtgaccttcccgagcggactcgcgtcgagccgccgcgcgacggcgtcggcgtcggcttttgccctcgtcgcaccgggccggtcgggggttcgtccccaggactcccgcagcaccgctgccgccagtgccgccgtcgtggccagcaccgcgagcggggttccggtggatccgccctgcgtctcgtggcgcgatacggcggtgacgccgtaggtgtgggctccgagcgcgagggcggcgggcagtgcgggcagcgacgcggtcaggccgccgcgcgccgttccggcaacgttgtcgggcgaactgctgccgcccggcgcgcgcacgcccgtcgccgtggccgtggccgtcgcacccagcagcaggtccagcgagcgggccgccgccatggccgccggacccgccttcgtgcgcttcaggtgcaggtcgtaggcccagaccgtggcggccaggcccgtggcgacggtcagcgcggggcggccggcccgggccgccagggcgaggcccgcggcggtcagcaccccggccgcgcccagggccgcccccgggctaacacggcccgaggggatcggacggtgcggccggggtgc

SEQ ID NO: 4676 - DNA, 793 bp, Unknown
  Kingdom: Bacteria, Phylum: Actinobacteria, Class: Actinobacteria, Order: Streptomycetales, Family: Streptomycetaceae, Genus: Streptomyces
gccgtgatcctgccgtgcgtccggggcatgggggagcggggccgggtcgacggcatcccggacctggccgccgagcacgtcctgcacggcatcggctcccgcgacacctacgtcatcggcgactgcgtggccgacctgtggtgcgccgcctccgccctcacggcactcgtcccggaactggcggaggccggcctcccgggcgggccccgcctcggctacctgggcgagagcttcggcggcggactcggggccctcgcgctgccctgggacgaccgtttcggcgcggcccagctcacggtccccaccttcggcaaccacccgctgcgcctgaccctgccctgcgcgggcagcggcgaggcggtccgggcgcaccaccgcgagcaccccgaggtcacggatgtcctcggctacttcgacgcggcgacggcggcgacccggctgaccctgcccacgctggtcgcggccgcgctgttcgacccgtccgtgccgccgccggggcagttcgccgtgcacaacgcgctggccggcgagcgcgaactccaggtgctgacggcggggcacttcgtgtaccggggcatggcggccgaggcggcggagctggacgcgaaccggacgcggttcttcggggagcggctgacggcggtgggctgagagcacgggctcgcggccgcggggttgaagcggcgggtccgcgcccgtacgacggcctccgcgccggggtcgtcccggcgccggcgcgtggctttgacggtccgccggacggctcagccgcagccgcagctcgcgcggcggg

SEQ ID NO: 4677 - DNA, 722 bp, Unknown
  Kingdom: Bacteria, Phylum: Actinobacteria, Class: Actinobacteria, Order: Streptomycetales, Family: Streptomycetaceae, Genus: Streptomyces
cacccggaccgccagcacccgccccagcccgcgaacgccacgctccgctggtcctccgacaagggttgggtggagcgcggcggccccctcggcgagccggcggagaccgcgtccctgccgaccctcgcccaggtcaccagcgccgaacagcgctgggcggaccgggaggaggacatcaccaccgtcggcggcgaccccttcgaagtgggccaggtcttcgcccgccgctggatggagcgcctgccggaaaccgtccacctgcagaaactctccaccatgtatccgcgcatcccgcaccggatcgacggcgagctgctgcggtacgcggcccgcttcgggctgctcgcccacaaggacgaccagatcgacgagcacgaccgctacgcgatccgggccggcttctggcgggagatcgacgtgcgggccgccgccgagcacgtaccggcgggggagtagccggccgcgccgcccggcggcgcggagtggccccggacgcgaaccggggcatgtgaccccgtaccctcgtacctcgtgagtacgggcacagcacaggcgcagagggacaccggcaccgtgtgcgcggtgcgcgatctggtcaggacctaccccgcggtccggggccgccggggcgcccccgcgacacccgaggtccgcgccacggacagcatcagtctggacgtcgaacgcggcgagatcttcggactgctcggccccaacggcgc

SEQ ID NO: 4678 - DNA, 587 bp, Unknown
  Kingdom: Bacteria, Phylum: Actinobacteria, Class: Actinobacteria, Order: Streptomycetales, Family: Streptomycetaceae, Genus: Streptomyces
ggctcgccgtcgccgcgctcgccgagaccggcgcgtacttcgaccggccggatctggtggagcgggccaccgaggccgccgatctgctggtccgggtgcatctgggcgaggtggcccggctgacccgtacctccaaggacgggcgcgccggtgacaacgccggggtgctggaggactacggcgatgtcgccgagggcttcctcgcgctggcggcggtgacgggggagggggcctggctggagttcgccgggttcctgctcgacatcgtgctggagcagttcaccggcgagggcgggcagctgtacgacaccgctcatgacgccgagcagctgatccgccggccccaggatccgacggacagcgccaccccctccgggtggaccgcggcggccggcgcgctgctctcgtacgccgcgtacaccgggtcggaggcccatcggacggccgccgagggtgcgctcggcgtggtgaaggcgctgggtccgcgggttccccggttcgtcggctggggcctcgcggtggccgaggcgctgctggacgggcccagtgaggtcgccgtggccgggccggtcggcggggagcggcac

SEQ ID NO: 4679 - DNA, 791 bp, Unknown
  Kingdom: Bacteria, Phylum: Actinobacteria, Class: Actinobacteria, Order: Streptomycetales, Family: Streptomycetaceae, Genus: Streptomyces
ggcctgcacgggaaccccggtgatcccggccttcgccgccgcacgctggaccgcctgcgccctgctttccgggcgaccggctccggcggcctgtgcgggcgcgcgcggcggcacccgtacgttgagaccgggcggcccgccgggagcgccaccgcccgcgagggccggtccggcgagcggaggaccggcgctctcggccgccacgggcatcgccagccgccgtacgggtacggcggcttccggatgcgccgctgcgggcggatgcggccggacgacgggaacagggcgcgtgccgggcgtggttgcggacgccggaggcctcgacggcgctgacggcattgccaggcccggccgggccggcagggcctgcgggagcggcgcggcacgttgaacaaccgggacggggaccggggcaggtgcgggtgcgggtacggaggcaggggcctggccggaggccgcggcggtgtgccgtgcggaaccctgctgctgtggcgtgccgggcggcgtggacgagggcgtggtggcccgcccggaccatcgtacgagtcgctggagtacgccaccggcggacggaccgcgcccggcgggggcggccgtggtccccggggagcgccccggttcgcttccaccgcgccggccggtgggtccggcgcctcgggtcgcggtgcccggtgccgggtcggtgaaggcggtgccgtcccggtgcgcggggtgcgtggcggccgagcgctggaccgtggcccccggttccgtaccggaggacgccgacggccggggaccggcgctcggcc

SEQ ID NO: 4680 - DNA, 640 bp, Unknown
  Kingdom: Bacteria, Phylum: Actinobacteria, Class: Actinobacteria, Order: Streptomycetales, Family: Streptomycetaceae, Genus: Streptomyces
cggggccggcccgctgtccggctccgtgcggtcggcacgccccgccgtggggcggctccaccacttcgcctgcggcccggtgggcttcccgtcgtccatgctctccccgcaactggcctctgtacgccccaccgaggcgtccctcaccggaattcaaccaggtttgcgaatcctcgcgcagggtccggtcagggccggggcgaaagcgggctcgccagatcgttggccggcgcgcccgggggcggccccggagaaaccgaggagggaaccgtcttcggcgccgcaccgctgccgagcgccgccgccagcagcggggtgccggacatcgtcggacgtatcagcggcgagacggacacattcagcacggggagcgtgaaggggtgcccgcccgaggtctggacgccgaacagcggcggcgcggtcggcggcccctgccggttcaccggaggggtgatgggagccacgggtgtcgcaccggtgagcgacgggggcacccggttcgttccggccggagccgtgccggacgcggaccgctcgatcgcccggccgtcgccggtgacggcgagggcgccgccgcccctgcggctgaccgctttcgcgccgctctcggcgcgggtcgcggcgtcgagcggggtggcgt

SEQ ID NO: 4681 - DNA, 851 bp, Unknown
  Kingdom: Bacteria, Phylum: Actinobacteria, Class: Actinobacteria, Order: Streptomycetales, Family: Streptomycetaceae, Genus: Streptomyces
ggctcggaagatgggtataggagccagggccagcgcctcgtccagaccggccgccgcccgctcccggtcctcctccaggagcgccccgaacgcccggcacagccccgaccggagcggcaccagcagcgactgctcgcctccggcccgccggaacgcggccagcgaccggtccatctcccgccgccgcccccggtgcgcggccatcgtcgccccggccagcagcagatagcggtgggcggaccggtcgccgacccgggcgctggcctccgccgagcggtcgatgatctcctgcgcctcctcccaccgggcgcacatcaccgcgttcatcgcgagcagtccgtcgaccgtacgggtcagcagcagcgcgcccagctcggtcgccgccgctcgcgcggagagcagccgggcggcgtccccggtccgcatgaaggcgttcgccccgagccgcaccagcgcctccacccgccagaccggcagggcgtgttcggtggagatcgacagcatccgctccagtgcggcgtccgccgcgtcgaaaccctcctcgcgccgcagcagcgccagcaactgccaggcctggcaggccaccacgggcagcccctcggcctcggcggtctccgcggcctcccgcacgacccgctcggagtcggccggatcccggggttcgcgcccatgtccggggagcagcgccagatacccgtcgaccaccacgagcgcggcccggcggcccggtggcggcgacgggccgagcaggacacgggccgcttccacctggagctccgcgtcggcggtgcgctccgccatgaccgccgcccaggcgagttcgatatggatcaggccgcgccgggcggcgg

SEQ ID NO: 4682 - DNA, 609 bp, Unknown
  Kingdom: Bacteria, Phylum: Actinobacteria, Class: Actinobacteria, Order: Streptomycetales, Family: Streptomycetaceae, Genus: Streptomyces
ggcatggggtgatcctcgcggaggacaccgcccgaaggccaacccgggtgcgcgacaagggtgtgccgggcgtcgcggccccggtcgggggccgccggacgcgccctaacccagcgcgcggagccccgggacgaaggccacgaacaccgggacgaccgggaccagcgcggcggcggccgtcagccggatcctgcggcccgccgtcagccgttcgaccggggccagcaaccggttgacccggaggggcacttgggcgtgcggagtggggcaggggccgaacaccccacggtcctcgttgagtccgaccagggcgagcgcggtcgtcagccggccgaagcggcgtgacgccacgtcgtcggcggccagttcgaccagccggtgcatctcgtcacggaacgcggcgaacaccgggatctgcgggaagccgatcgccagcgccgacgagcagtgcagcagccagtcgtgccgggcccgggcgtgaccctgctcgtgggcgagcacggcatcgagctgacggcccttcagccgacccagcgcggcggtcgtgatgacgagttgcggagccgtgccgggcagccaccaggcgtcggggcgttcgccctccagcac

SEQ ID NO: 4683 - DNA, 557 bp, Unknown
  Kingdom: Bacteria, Phylum: Actinobacteria, Class: Actinobacteria, Order: Streptomycetales, Family: Streptomycetaceae, Genus: Streptomyces
gcatcgccgtgctcaccaccaatctgcgggccaacctcgacgaggcgttcacccgccgcctcgatgtgatcgccgagttcccgatgcccgacgcccggcagcgcctggccctgtgggaccgctgtctgggcccggcgataccgcgcgacgccgcgctcgacctggagttctgcgcggaccgcttcgagctggccggcgggtcgatccgggcctgcgcggtgaccgccgcctacctcgcggccgcttcgggagcgccgctgggcatggaccagctcgtcacctcggtgctccaggagtaccgcaagctcggacggctggtgctggagagcgagttcgggccgtggctggcgaaggagcgggggcgcggcggtcggtagcggacgcctcggcgacgtggaggccgacttccgtccggcgcgggcgtcagcgtccgcgctccggtccgacgcggctgagggcggcccggtcccaggcggcctcgcgcaggaggcggagaccgttgaggccgacgatgacggtcgaaccctcgtgcccggcgacaccgagcgggaggggga

SEQ ID NO: 4684 - DNA, 535 bp, Unknown
  Kingdom: Bacteria, Phylum: Actinobacteria, Class: Actinobacteria, Order: Streptomycetales, Family: Streptomycetaceae, Genus: Streptomyces
cgccggggccgctcccgtcgaggagggcgatcccggctacgcaccccacctggaccgcgacggcgacggtgtggggtgcgagccgtggggtgagtccgcctcgtcctccggcggaggcggtacgagtggtgggggtgggggcggcagcgtctcctacgcgaactgcaccgccgtacggaacgcgggcgccgcacccatccgggccggggacccgggctacggacggcacttggaccgcgacggggacggcgtcgcctgcgagtgagccgcgcccgggacggggggcgtaccggcctaccagctgtgccggtacgcccgtacgcccgcccgcccggcggcaccgtcaccccgaacgctagcctcgggcggaggagccaaccacaggtataccgacggctcacaggaagcgatggtggcgacgatggcgaagattccggcgacggcagtggcggcgagcgggctcatcgggggctacggcgtcgcccggtggaccaagaagcggccgctcggcggcgtcgcgctcgccgccgccggg

SEQ ID NO: 4685 - DNA, 672 bp, Unknown
  Kingdom: Bacteria, Phylum: Actinobacteria, Class: Actinobacteria, Order: Streptomycetales, Family: Streptomycetaceae, Genus: Streptomyces
gacgtcgagcgcctcaaggctgaacacgccgagctggagcccattctgagccggatccgcttggtcgcagacgcgctgccccatatgggaggcagtgccgcaaaaggcgcgctgctatcgctcaaccagtccttggctgacgtcctggtaccacatgagcgccgagacgatacccagctctatccggacgtcgcccgcctgctcggtggagacgacccgatggcggcaatgagcgccatgcatcgcgagatattccgcgtgacgaacctgtggggccgaatcgtggcggatgtttccgccgacggccccgatgccgctgtgacgcaagagctgcaacgcttgctgtatgggctcgatgccatcctgcggctgcattgcgcgcaagaagacgaactgttccatgtgctcggtggggaggcttgatcaacatggcaaacctgcttgcgttgttcgggacagtcttcttgctcaatgtgatgccggccttcgcaccgccgacgtggatggtgatgtcatgggtcggcttctcgcgacccgaggccgaccccgtgattcttgcaggcgttgccgcttgtgcagcgacggtcggccggctggtgctggcgcggctctcttgctcactcgtgcgcaaccgctggatgcgcgaggccgatcgccagaacatcgatgtgg

SEQ ID NO: 4686 - DNA, 653 bp, Unknown
  Kingdom: Bacteria, Phylum: Actinobacteria, Class: Actinobacteria, Order: Streptomycetales, Family: Streptomycetaceae, Genus: Streptomyces
gaacagcaccacgctgtaggggttgcgccgcaccttctcggtcagctggccggcctcgtcgtaaccgacgtatccgggcggcgctccgacgagccgggcgaccgtgtgcttctcctggaactcgctcatgtcgaaccggaccatgcggtcgtcgtcgccgaacagcagctcggccagcgtcttggcgagttcggtcttgccgacgccggtgggcccgaggaagaggaacgagccgacgggcctgttcgggtcacccatgcccgcgcggttgcggcgtacggcttgggagaccgcggtgaccgcctcgtcctggccgacgatcctggcgtgcatctcctgctccagtttgaggagcttctccttctcgccggcggtgagccgggagaccgggatgccggtgcggcgggagacgatgtcggcgatgtcggaggccgtgaccgagacgacgccctcgcggcgttcctcgatcccggcgagttccccctccacctcggcgatctgccgcttcagcccggaggccttctcgaactcctcgccggcgacggcctcgtccttctcgcgccgcagcttggccaggcggtcctcacggctgacgacctcggtggagcggttcgcgctgcgcagccgtacgcgggccccggcctggtccatca
